(12) United States Patent
Wood et al.

(10) Patent No.: US 7,871,610 B2
(45) Date of Patent: *Jan. 18, 2011

(54) ANTIBODIES TO TIE1 ECTODOMAIN

(75) Inventors: Clive R. Wood, Cambridge, MA (US); Daniel T. Dransfield, Hanson, MA (US); Henk Pieters, Maastricht (NL); Rene Hoet, Maastricht (NL); Simon E. Hufton, Lancs (GB)

(73) Assignee: Dyax Corp., Cambridge, MA (US)

( * ) Notice: Subject to any disclaimer, the term of this patent is extended or adjusted under 35 U.S.C. 154(b) by 455 days.

This patent is subject to a terminal disclaimer.

(21) Appl. No.: 11/049,536

(22) Filed: Feb. 2, 2005

(65) Prior Publication Data

US 2006/0024297 A1 Feb. 2, 2006

Related U.S. Application Data

(63) Continuation-in-part of application No. 10/916,840, filed on Aug. 12, 2004, now Pat. No. 7,348,001.

(60) Provisional application No. 60/494,713, filed on Aug. 12, 2003.

(51) Int. Cl.
*A61K 39/395* (2006.01)
*C07K 16/28* (2006.01)
*C12P 21/08* (2006.01)
*G01N 33/53* (2006.01)

(52) U.S. Cl. ............... 424/130.1; 424/133.1; 424/141.1; 424/143.1; 530/387.1; 530/388.1; 530/388.15; 530/388.22

(58) Field of Classification Search ........................ None
See application file for complete search history.

(56) References Cited

U.S. PATENT DOCUMENTS

| | | | |
|---|---|---|---|
| 5,521,073 | A | 5/1996 | Davis et al. |
| 5,851,797 | A | 12/1998 | Valenzuela et al. |
| 5,955,291 | A | 9/1999 | Alitalo et al. |
| 6,090,382 | A | 7/2000 | Salfeld et al. |
| 6,365,154 | B1 | 4/2002 | Holmes et al. |
| 6,376,653 | B1 | 4/2002 | Holmes et al. |
| 6,441,137 | B1 | 8/2002 | Davis et al. |
| 6,492,331 | B1 | 12/2002 | Godowski et al. |
| 6,551,822 | B1 | 4/2003 | Godowski et al. |
| 6,586,397 | B1 | 7/2003 | Godowski et al. |
| 6,627,415 | B1 | 9/2003 | Davis et al. |
| 7,193,064 | B2 | 3/2007 | Mikayama et al. |
| 2002/0115173 | A1 | 8/2002 | Ben-Sasson |
| 2002/0160478 | A1 | 10/2002 | Ben-Sasson |
| 2003/0040463 | A1 | 2/2003 | Wiegand et al. |
| 2003/0087393 | A1 | 5/2003 | O'Reilly et al. |
| 2003/0113782 | A1 | 6/2003 | Karim et al. |
| 2003/0152945 | A1 | 8/2003 | Deak et al. |
| 2003/0162712 | A1 | 8/2003 | Cerretti et al. |
| 2003/0166858 | A1 | 9/2003 | Davis et al. |
| 2003/0180718 | A1 | 9/2003 | Pillutla et al. |
| 2003/0219772 | A1 | 11/2003 | Kuyl et al. |
| 2004/0067882 | A1 | 4/2004 | Alsobrook II et al. |
| 2004/0116330 | A1 | 6/2004 | Naito et al. |
| 2004/0147449 | A1 | 7/2004 | Siemeister et al. |
| 2004/0248781 | A1 | 12/2004 | Kerbel |
| 2006/0013449 | A1 | 1/2006 | Marschner et al. |
| 2006/0057138 | A1 | 3/2006 | Wood et al. |

FOREIGN PATENT DOCUMENTS

| | | |
|---|---|---|
| EP | 1225233 A2 | 7/2002 |
| WO | WO93/14124 | 7/1993 |
| WO | WO95/26364 | 10/1995 |
| WO | WO-95/26364 A1 | 10/1995 |
| WO | WO-01/11086 A2 | 2/2001 |
| WO | WO-01/47944 A2 | 7/2001 |
| WO | WO01/72339 | 10/2001 |
| WO | WO03/094904 | 11/2003 |
| WO | WO2004/108130 | 12/2004 |
| WO | WO2005/019267 | 3/2005 |
| WO | WO2006/020706 | 2/2006 |
| WO | WO2007/095338 | 8/2007 |

OTHER PUBLICATIONS

Rudikoff et al., Single acid amino acid substitution altering antigen-binding specificity. Proc. Natl. Acad. Sci., USA, 79, 1979-1983, 1982.*

Kobrin et al., A V region mutation in a phosphocholine-binding monoclonal antibody results in loss of antigen binding. J. Immunol., 146, 2017-2020,1991.*

Barrios et al., Length of the antibody heavy chain complementarity-determining region 3 as a specificity-determining factor. J. Molec. Recog., 17, 332-338, 2004.*

Chen-Konak et al., "Transcriptional and post-translation regulation of the Tie1 receptor by fluid shear stress changes in vascular endothelial cells," FASEB J.(2003) 17:2121-23.

Jones et al., "Tie receptors: new modulators of angiogenic and lymphangiogenic responses," Nat Rev. Mol. Cell Biol. (Apr. 2001) 2(4):257-67.

Kontos et al., "The endothelial receptor tyrosine kinase Tie1 activates phosphatidylinositol 3-kinase and Akt to inhibit apoptosis," Mol. Cell Biol. Mar. 2002;22(6):1704-13.

Lin et al., "Tie-1 protein tyrosine kinase: a novel independent prognostic marker for gastric cancer," Clin. Cancer Res. (Jul. 1999) 5(7):1745-51.

(Continued)

*Primary Examiner*—Lorraine Spector
*Assistant Examiner*—Elly-Gerald Stoica
(74) *Attorney, Agent, or Firm*—McCarter & English, LLP; Maria Laccotripe Zacharakis; Marcie B. Clarke

(57) ABSTRACT

Tie1 and Tie2 are receptor tyrosine kinase proteins that include a transmembrane domain. Tie1 and Tie2 are present on endothelial cells. This disclosure describes agents, such as antibodies, that bind to Tie1, Tie2, and Ang, including ones that inhibit endothelial cell activity.

29 Claims, 6 Drawing Sheets

OTHER PUBLICATIONS

Loughna and Sato, "A combinatorial role of angiopoietin-1 and orphan receptor TIE1 pathways in establishing vascular polarity during angiogenesis," Mol. Cell (2001) 7:233-39.

Marron et al., "Tie-1 receptor tyrosine kinase endodomain interaction with SHP2: potential signallimg mechanisms and roles in angiogenesis," Adv. Exp. Med. Biol. (2000) 476:35-46.

Marron et al., "Evidence for heterotypic interaction between the receptor tyrosine kinases TIE-1 and TIE-2," J Biol Chem. (Dec. 2000) 15;275(50):39741-6.

Partanen et al., "A novel endothelial cell surface receptor tyrosine kinase with extracellular epidermal growth factor homology domains," Mol. Cell Biol. (Apr. 1992) 12(4):1698-707.

Puri et al., "The receptor tyrosine kinase TIE is required for integrity and survival of vascular endothelial cells," EMBO J. (Dec. 1, 1995) 14(23):5884-91.

Shahrara et al., "Differential expression of the angiogenic Tie receptor family in arthritic and normal synovial tissue," Arthritis Res. (2002) 4:201-208.

Tsiamis et al., "Characterization and regulation of the receptor tyrosine kinase Tie-1 in platelets," J. Vasc. Res. (Nov.-Dec. 2000) 37:437-42.

Blakey, David C. et al., "Antitumor Activity of the Novel Vascular Targeting Agent ZD6126 in a Panel of Tumor Models," *Clinical Cancer Research*, vol. 8:1974-1983 (2002).

Davis, Samuel et al., "Isolation of Angiopoietin-1, a Ligand for the TIE2 Receptor, by Secretion-Trap Expression Cloning," *Cell*, vol. 87:1161-1169 (1996).

Hurwitz, Herbert et al., "Bevacizumab plus Irinotecan, Fluorouracil, and Leucovorin for Metastic Colorectal Cancer," *The New England Journal of Medicine*, vol. 350(23):2335-2342 (2004).

Partanen, Juha et al., "A Novel Endothelial Cell Surface Receptor Tyrosine Kinase with Extracellular Epidermal Growth Factor Homology Domains," *Molecular and Cellular Biology*, vol. 12(4):1698-1707 (1992).

International Search Report for Application No. PCT/US04/26116, dated Nov. 2, 2007.

International Search Report for Application No. PCT/US07/81621, dated Mar. 14, 2008.

International Search Report for Application No. PCT/US05/28413, dated Aug. 8, 2006.

International Search Report for Application No. PCT/US08/50870, dated Aug. 27, 2008.

Hurwitz et al., "Bevacizumab plus Irinotecan, fluorouracil and leucovorin for metastatic colorectal cancer", New England Journal of Med. 350:2335-2342 (2004).

International Search Report dated Nov. 2, 2007 from International Application No. PCT/US04/26116.

Shen Juqun et al., "An antibody directed against PDGF receptor beta enhances the antitumor and the anti-angiogenic . . ." Biochem. Biophys. Res. Comm., 357(4):1142-1147 (2007).

Jo Nobuo et al., "Inhibition of platelet-derived growth factor B signaling enhances the efficacy of anti-vascular endothelial . . ." Am. J. Pathology, 168(6):2036-2053 (2006).

Dransfield et al., "100 Poster Targeting tie-1 inhibits the growth of tumor xenografts as monotheraphy and has increased activity . . ." Eur. J. Cancer. Suppl., 4(12):34 (2006).

Tol Jolien et al., "Chemotherapy, Bevacizumab and Cetuximab in Metastatic Colorectal Cancer," New England J. Med., 360(6):563-572 (2009).

* cited by examiner

ANTIBODIES TO TIE1 ECTODOMAIN

CROSS-REFERENCE TO RELATED APPLICATIONS

This application is a continuation in part of U.S. Application Ser. No. 10/916,840, filed Aug. 12, 2004 now U.S. Pat. No. 7,348,001, which claims priority to U.S. Application Ser. No. 60/494,713, filed on Aug. 12, 2003, the contents of which are hereby incorporated by reference in their entirety.

SUBMISSIONS ON COMPACT DISC

This application incorporates by reference ASCII text file identified by the name 10280-128001.txt, containing 668 KB of data, and created on Sep. 29, 2005, filed in computer-readable format (CRF) and encoded on the CD-ROM, mailed Oct. 7, 2005.

BACKGROUND

The oxygen and nutrients supplied by the blood vessels are crucial for tissue development and function. Indeed, the cardiovascular system is the first organ system to develop in embryos. During organogenesis and the development of tissues or tumors, the proximity of the growing cells to the circulatory system is ensured by the coordinated growth of blood vessels and organ parenchyma. It may be possible to prevent or treat diseases by modulating blood vessel development or angiogenesis.

Blood vessels are composed of an inner layer of endothelial cells and an outer layer of pericytes or smooth muscle cells. The first tubular structures are formed by endothelial cells that subsequently recruit pericytes and smooth muscle cells to ensheath them. The de novo formation of blood vessels from a dispersed population of mesodermally derived endothelial precursor cells is termed vasculogenesis. This primitive network undergoes successive morphogenetic events including sprouting, splitting, and remodeling to generate the hierarchical vascular network from large to branched small vessels. These successive morphogenetic events are collectively called angiogenesis. Previous studies have identified a number of endothelial cell specific receptor tyrosine kinases (RTKs) and their cognate ligands, which mediate the vasculogenic and angiogenic development of blood vessels. Members of the vascular endothelial growth factor (VEGF) family and their receptors function during the formation of the initial embryonic vascular plexus, whereas angiopoietins (Angs) and their receptor, Tie2, as well as ephrins and their Eph receptors are implicated in the subsequent remodeling processes. See, e.g., Jones et al. (2001) *Nat. Rev. Molec. Cell Biol.* 2:257 for a review of receptors involved in angiogenic and lymphangiogenic responses.

Tie1 and Tie2 are RTKs that are expressed almost exclusively in endothelial cells and hematopoietic precursor cells. These two receptors are required for the normal development of vascular structures during embryogenesis. The two Tie receptors form a RTK subfamily since, unlike other RTK family members, they include extracellular EGF-homology domains. See, e.g., Partanen (1992) *Mol. Cell Biol.* 12:1698 and WO 93/14124. Targeted disruption of the Tie1 gene in mice results in a lethal phenotype characterized by extensive hemorrhage and defective microvessel integrity. See, e.g., Puri et al. (1995) *EMBO J.* 14:5884. Tie2 null embryos have defects in vascular remodeling and maturation, resulting from improper recruitment of periendothelial supporting cells.

Angiopoietins (Ang, e.g., Ang1, Ang2, Ang3, and Ang4) are proteins that interact with Tie2.

SUMMARY

In one aspect, the invention features a method of modulating Tie complex formation, or interactions between Tie complex components, in a subject. The method includes administering to a subject an agent that antagonizes an association between at least two of the following: Tie1, Tie2, and an angiopoietin (Ang; such as Ang1, Ang2, Ang3, or Ang4). In one embodiment, the agent antagonizes formation of a heteromeric complex of Tie1, Tie2, and Ang. In another embodiment, the binding of the agent can antagonize the association between Tie1 and Tie2, between Tie1 and Ang, or between Tie2 and Ang.

In one embodiment, the agent binds to Tie1. In one embodiment, the agent antagonizes formation of a heteromeric complex of Tie1, Tie2, and Ang. In another embodiment, the binding of the agent can antagonize the association between Tie1 and Tie2, between Tie1 and Ang, or between Tie2 and Ang. In another embodiment, the agent enhances Tie1 self-association, e.g., homodimerization, and thereby associates Tie1 with Tie1 and prevents association of Tie1 with Tie2 and/or Ang. In one embodiment, the agent increases phosphorylation of Tie1, e.g., Tie1 autophosphorylation. This increase need not depend on Tie1 self-association or homodimerization.

In one embodiment, the agent includes a protein, such as an antibody, that binds to the extracellular domain of human Tie1. For example, the antibody can be one or more of the following: human, humanized, non-immunogenic, isolated, monoclonal, and recombinant. In one embodiment, the antibody can bind to the first Ig-like C2-type domain (Ig 1) or to the second Ig-like C2-type domain (Ig 2) of Tie1. In one embodiment, the antibody binds to an EGF-like domain of Tie1 (e.g., first, second, or third EGF-like domain). In one embodiment, the antibody binds to the fibronectin type III repeats region of Tie1. In one embodiment, the antibody binds to amino acid residues 24-124, 74-174, 124-224, 174-274, 224-324, 274-374, 324424, 374-474, 424-524, 474-574, 524-624, 574-674, 624-724, 674-759, or 724-759 of SEQ ID NO:2.

In one embodiment, the agent includes a protein that binds to a Tie1 ectodomain and includes a heavy chain (HC) immunoglobulin variable domain sequence and a light chain (LC) immunoglobulin variable domain sequence. The protein can further include one or more of the following properties:

(1) at least one of the variable domain sequences includes at least one CDR of the E3 or E3b antibody (e.g,. one, two, or three CDRs of the E3 or E3b antibody);

(2) at least one of the variable domain sequences includes CDR sequences at least 85% identical, in sum, to the CDRs of the corresponding variable domain of the E3 or E3b antibody, (3) at least one of the variable domains is at least 85% identical to the corresponding immunoglobulin variable domains of the E3 or E3b antibody, and (4) the protein competes with E3 or E3b for binding to Tie1 or binds to an epitope that overlaps the epitope bound by E3 or E3b on Tie1.

In one embodiment, the agent comprises the E3 or E3b antibody.

In one embodiment, the agent includes the HC and/or LC variable domain of the E3 or E3b antibody, or a sequence at least 70, 80, 85, 90, 95, 98, 99% identical to the HC and/or LC variable domains of the E3 or E3b antibody. In one embodiment, the amino acid sequences of the HC variable domain sequence include CDR1, CDR2, and CDR3 sequences from the E3 or E3b clone and the LC variable domain sequence includes CDR1, CDR2, and CDR3 sequences from the E3 or E3b clone. In one embodiment, the LC variable domain sequence includes SEQ ID NO:159. In one embodiment, the HC variable domain sequence includes SEQ ID NO:114. In one embodiment, the HC and LC framework regions are human.

In one embodiment, the agent binds to Tie2. In one embodiment, the agent antagonizes formation of a heteromeric complex of Tie1, Tie2, and Ang. In another embodiment, the binding of the agent can antagonize the association between Tie1 and Tie2, between Tie1 and Ang, or between Tie2 and Ang. In another embodiment, the agent enhances Tie2 self-association, e.g., homodimerization, and, thereby associates Tie2 with Tie2 and prevents association of Tie2 with Tie1 and/or Ang. In one embodiment, the agent includes a protein, e.g., an antibody that binds to the extracellular domain of human Tie2. For example, the antibody can be one or more of the following: human, humanized, non-immunogenic, isolated, monoclonal, and recombinant. In one embodiment, the antibody can bind to the first Ig-like C2-type domain (Ig 1) or to the second Ig-like C2-type domain (Ig 2) of Tie2. In one embodiment, the antibody binds to an EGF-like domain of Tie2 (e.g., first, second, or third EGF-like domain). In one embodiment, the antibody binds to the fibronectin type III repeats region of Tie2. In one embodiment, the antibody binds to amino acid residues 19-119, 69-169, 119-229, 169-269, 229-329, 269-369, 329-429, 369-469, 429-529, 469-569, 529-629, 569-669, 629-729, 669-745, 729-745 of SEQ ID NO:162.

In one embodiment, the agent binds to Ang. In one embodiment, the agent antagonizes formation of a heteromeric complex of Tie1, Tie2, and Ang. In another embodiment, the binding of the agent can antagonize the association between Tie1 and Tie2, between Tie1 and Ang, or between Tie2 and Ang. In one embodiment, the agent includes a protein, e.g., an antibody that binds to Ang. For example, the antibody can be one or more of the following: human, humanized, non-immunogenic, isolated, monoclonal, and recombinant. In one embodiment, the antibody binds to the N-terminal domain of Ang1 (i.e., the N-terminal 50 amino acids of Ang1). In one embodiment, the antibody binds to the coiled-coil domain of Ang1. In one embodiment, the antibody binds to the fibrinogen-like domain of Ang1. In one embodiment, the antibody binds to amino acid residues 1-100, 50-150, 100-200, 150-250, 200-300, 250-350, 300-400, 350-450, 400-497, or 450-497 of SEQ ID NO:163.

In one embodiment, the agent of the invention includes a protein that contains a heavy chain (HC) immunoglobulin variable domain sequence and a light chain (LC) immunoglobulin variable domain sequence.

In one embodiment of the invention, the HC and LC framework regions are human. In one embodiment, the agent of the invention also includes an Fc domain. In one embodiment, the agent includes the constant domains of a human IgG1, IgG2, IgG3, or IgG4.

In one embodiment, the agent is administered in an amount effective to decrease angiogenesis.

In one embodiment, the subject has an angiogenesis-related disorder. In other embodiments, the subject has for example: a neoplastic disorder, metastatic cancer, an angiogenesis-dependent cancer or tumor, an inflammatory disorder, rheumatoid arthritis, or psoriasis.

In one embodiment, the protein is delivered systemically.

In another embodiment, the protein is administered in an amount effective to reduce one or more of the following activities: sprouting, splitting, remodeling of blood vessels, vasculogenesis, and tubule formation. The method can include other features described herein.

In one aspect, the invention includes a method of decreasing or inhibiting endothelial cell activity in the subject, the method includes administering an agent that decreases or inhibits Tie complex formation in an amount effective to decrease or inhibit endothelial cell activity in the subject. The method can include other features described herein.

In one aspect, the invention includes a method of decreasing endothelial cell activity by administering an agent that causes Tie1 phosphorylation. In one embodiment, the phosphorylation decreases endothelial cell differentiation, e.g., sprouting, splitting, and tube formation.

In another aspect, the invention includes a method of decreasing endothelial cell activity, the method by administering an agent that activates a signaling pathway. In one embodiment, the signaling pathway decreases endothelial cell differentiation, e.g., sprouting, splitting, and tube formation. For example, the agent increases Tie1 autophosphorylation. The method can include other features described herein.

In one aspect, the invention includes an antibody for modulating Tie complex formation in a subject, wherein the antibody antagonizes an association between at least two of the following: Tie1, Tie2, and an angiopoietin (Ang). In one embodiment, the antibody binds to a Tie complex component or to one or more of Tie1, Tie2, and an Ang. In one embodiment, the antibody antagonizes formation of a heteromeric complex of Tie1, Tie2, and Ang. In another embodiment, the antibody can antagonize the association between Tie1 and Tie2, between Tie1 and Ang, or between Tie2 and Ang.

In one embodiment, the antibody binds to Tie1. In one embodiment, the antibody antagonizes formation of a heteromeric complex of Tie1, Tie2, and Ang. In another embodiment, the binding of the antibody can antagonize the association between Tie1 and Tie2, between Tie1 and Ang, or between Tie2 and Ang. In another embodiment, the antibody enhances Tie1 self-association, e.g., homodimerization, and thereby associates Tie1 with Tie1 and prevents association of Tie1 with Tie2 or Ang. In another embodiment, the antibody increases Tie1 phosphorylation and/or prevents association of Tie 1 with Tie2 or Ang. In one embodiment, the antibody includes an antibody that binds to the extracellular domain of human Tie1. For example, the antibody can be one or more of the following: human, humanized, non-immunogenic, isolated, monoclonal, and recombinant. In one embodiment, the antibody can bind to the first Ig-like. C2-type domain (Ig 1) or to the second Ig-like C2-type domain (Ig 2) of Tie1. In one embodiment, the antibody binds to an EGF-like domain of Tie1 (e.g., first, second, or third EGF-like domain). In one embodiment, the antibody binds to the fibronectin type III repeats region of Tie1. In one embodiment, the antibody binds to amino acid residues 24-124, 74-174, 124-224, 174-274, 224-324, 274-374, 324-424, 374-474, 424-524, 474-574, 524-624, 574-674, 624-724, 674-759, or 724-759 of SEQ ID NO:2.

In one embodiment, the antibody binds to a Tie1 ectodomain and includes a heavy chain (HC) immunoglobulin variable domain sequence and a light chain (LC) immunoglobulin variable domain sequence, the protein further includes one or more of the following properties: (1) at least one of the variable domain sequences includes at least one CDR of the E3 or E3b antibody; (2) at least one of the variable domain sequences includes CDR sequences at least 85% identical, in sum, to the CDRs of the corresponding variable domain of the E3 or E3b antibody; (3) at least one of the variable domains is at least 85% identical to the corresponding immunoglobulin variable domains of the E3 or E3b antibody, and (4) the protein competes with E3 or E3b for binding to Tie1 or binds to an epitope that overlaps the epitope bound by E3 or E3b on Tie1.

In one embodiment, the antibody comprises the E3 or E3b antibody.

In one embodiment, the antibody includes one or more variable domains from the E3 or E3b antibody or a variable domain sequence that is at least 70, 75, 80, 85, 90, 95, 98, or 995 identical to such a variable domain. In one embodiment, the amino acid sequences of the HC variable domain sequence include CDR1, CDR2, and CDR3 sequences from the E3 or E3b clone, and the LC variable domain sequence includes CDR1, CDR2, and CDR3 sequences from the E3 or E3b clone. In one embodiment, the LC variable domain sequence includes SEQ ID NO:159. In one embodiment, the HC variable domain sequence includes SEQ ID NO:114. In one embodiment of the invention, the HC and LC framework regions are human.

In one embodiment, the antibody binds to Tie2. In one embodiment, the antibody antagonizes formation of a heteromeric complex of Tie1, Tie2, and Ang. In another embodiment, the binding of the antibody can antagonize the association between Tie1 and Tie2, between Tie1 and Ang, or between Tie2 and Ang. In another embodiment, the antibody enhances Tie2 self-association, e.g., homodimerization, and thereby associates Tie2 with Tie2 and prevents association of Tie2 with Tie1 or Ang. In one embodiment, the antibody causes Tie1 phosphorylation. In one embodiment, the antibody prevents association of Tie1 with Tie2 or Ang. In one embodiment, the antibody includes an antibody that binds to the extracellular domain of human Tie2. The antibody may have one or more of these properties, e.g., the antibody may cause Tie1 phosphorylation and prevent association of Tie1 with Tie2 or Ang, etc.

For example, the antibody can be one or more of the following: human, humanized, non-immunogenic, isolated, monoclonal, and recombinant. In one embodiment, the antibody can bind to the first Ig-like C2-type domain (Ig 1) or to the second Ig-like C2-type domain (Ig 2) of Tie2. In one embodiment, the antibody binds to an EGF-like domain of Tie2 (e.g., first, second, or third EGF-like domain). In one embodiment, the antibody binds to the fibronectin type III repeats region of Tie2. In one embodiment, the antibody binds to amino acid residues 19-119, 69-169, 119-229, 169-269, 229-329, 269-369, 329-429, 369-469, 429-529, 469-569, 529-629, 569-669, 629-729, 669-745, 729-745 of SEQ ID NO:162.

In one embodiment, the antibody binds to Ang. In one embodiment, the antibody antagonizes formation of a heteromeric complex of Tie1, Tie2, and Ang. In another embodiment, the binding of the antibody can antagonize the association between Tie1 and Tie2, between Tie1 and Ang, or between Tie2 and Ang. For example, the antibody can be one or more of the following: human, humanized, non-immunogenic, isolated, monoclonal, and recombinant. In one embodiment, the antibody binds to the N-terminal domain of Ang1 (i.e., the N-terminal 50 amino acids of Ang1). In one embodiment, the antibody binds to the coiled-coil domain of Ang1. In one embodiment, the antibody binds to the fibrinogen-like domain of Ang1. In one embodiment, the antibody binds to amino acid residues 1-100, 50-150, 100-200, 150-250, 200-300, 250-350, 300-400, 350-450, 400-497, or 450497 of SEQ ID NO:163.

In one embodiment, the antibody includes a heavy chain (HC) immunoglobulin variable domain sequence and a light chain (LC) immunoglobulin variable domain sequence.

In one embodiment of the invention, the HC and LC framework regions are human. In one embodiment, the antibody of the invention also includes an Fc domain. In one embodiment, the antibody includes the constant domains of a human IgG1, IgG2, IgG3, or IgG4.

In one embodiment, the antibody is administered in an amount effective to decrease angiogenesis.

In one embodiment, the antibody is delivered systemically. In one embodiment, antibody is administered in an amount effective to reduce one or more of the following activities: sprouting, splitting, remodeling of blood vessels, vasculogenesis, and tubule formation.

In one aspect, the invention includes an isolated protein that includes one or more variable domains of an antibody described herein.

In one aspect, the invention includes a nucleic acid that includes a coding sequence that encodes a polypeptide that includes a variable domain of an antibody described herein.

In one aspect, the invention includes a pharmaceutical composition that includes an antibody described herein. The composition and antibody can include other features described herein.

In one aspect, the invention includes an antibody described herein for treatment of an angiogenesis-related disorder. The antibody and treatment can include other features described herein.

In one aspect, the invention includes an antibody described herein for the manufacture of a medicament for treating an angiogenesis-related disorder. The medicament and antibody can include other features described herein.

In one aspect, the invention includes a method of providing a first therapy that includes administering an agent that decreases Tie complex formation in combination with a second therapy, e.g., an anti-cancer therapy. In one embodiment, the second therapy includes administering a second agent that antagonizes or decreases Tie complex formation. In one embodiment, the second therapy includes radiation therapy.

In one embodiment, the second therapy includes administering an agent that antagonizes signaling through a VEGF pathway, e.g., a VEGF antagonist antibody, e.g., bevacizumab; VEGF-Receptor tyrosine kinase inhibitor, or another agent that antagonizes VEGF pathway signalling.

In another aspect, the invention includes a composition that includes an agent that decreases Tie complex formation and an anti-cancer agent. For example, the anti-cancer agent can be a second agent that antagonizes Tie complex formation or a second agent that antagonizes a VEGF pathway.

In one aspect, the invention features an antibody that decreases endothelial cell activity by causing Tie1 phosphorylation. For example, the antibody may decrease endothelial cell differentiation, e.g., sprouting, splitting, and tube formation.

In another aspect, the invention features an antibody that decreases endothelial cell activity by activating a signaling pathway. For example, the antibody may decrease endothelial cell differentiation, e.g., sprouting, splitting, and tube formation.

In one aspect, the invention features a protein (e.g., an isolated protein) that includes a heavy chain immunoglobulin variable domain sequence and a light chain immunoglobulin variable domain sequence and binds to Tie1 ectodomain. The binding protein binds to Tie1 ectodomain. For example, the protein binds with an affinity $K_D$ of less than $10^{-8}$ M, $5 \cdot 10^{-9}$ M, $10^{-9}$ M, $10^{-10}$ M, $10^{-11}$ M, or $10^{-12}$ M.

In one embodiment, one or more of the CDRs of the heavy and/or light chain variable domain sequence are human, primate, non-rodent (e.g., non-mouse or non-rat), or synthetic. In one embodiment, one or more of the framework regions of the heavy and/or light chain variable domain sequence are human, primate, or non-rodent (e.g., non-mouse or non-rat).

In one embodiment, the heavy chain variable domain sequence includes one or more of the following properties:

i) a HC CDR1 that includes an amino acid sequence as follows:
(AGSR)-Y-(GVK)-M-(GSVF), (SEQ ID NO:117)
(AGSIMRH)-Y-(GVMK)-M-(GSVMFH) (SEQ ID NO:118), or
(AGSIMRNH)-Y-(AGTVMKPQ)-M-(AGSTVMYW-FKH) (SEQ ID NO:119);

ii) a HC CDR2 that includes an amino acid sequence as follows:
X-I-Y-P-S-G-G-X-T-X-Y-A-D-S-V-K-G (SEQ ID NO:120), wherein X is any amino acid,
(GSV)-I-(SY)-P-S-G-G-(WQ)-T-(GY) (SEQ ID NO:121),
(GSV)-I-(SY)-P-S-G-G-(WNQ)-T-(GY) (SEQ ID NO:160)
(GSV)-I-(SY)-P-S-G-G-(WQ)-T-(GY)-Y-A-D-S-V-K-G (SEQ ID NO:122),
(GSVW)-I-(SY)-P-S-G-G-(AGVMYWPQH)-T-(AG-STLVMYFKH) (SEQ ID NO:123), or
X-I-Y-P-S-G-G-(WPS)-T-(YVH)-Y-A-D (SEQ ID NO:1), wherein X is any amino acid;

iii) a HC CDR3 that includes an amino acid sequence as follows:
V-(four or five residues)-F-D-(I/Y) (SEQ ID NO:124),
G-Y-G-P-I-A-P-G-L-D-Y (SEQ ID NO:125),
(GV)-N-Y-Y-(GYD)-S-(SD)-G-Y-G-P-I-A-P-G-L-D-Y (SEQ ID NO:126),
(GVD)-(AGLN)-(LYR)-(GSTLYH)-(GYD)-(AGSYFP)-(SFD)-(AGYD)-(IY)-(GFD)-(YDP)-(IP)-A-P-G-L-D-Y (SEQ ID NO:127),
VNYYDSSGYGPIAPGLDY (SEQ ID NO:128), or
G-X-X-G-(AY)-F-D-(YI) (SEQ ID NO:705), wherein X is any amino acid.

In one embodiment, the light chain variable domain sequence includes one or more of the following properties:

i) a LC CDR1 that includes an amino acid sequence as follows:
R-A-S-Q-S-(IV)-S-(SR)-X1-Y-L-(AN) (SEQ ID NO:129),
R-A-S-Q-S-(IV)-S-S-(YS)-L-(ALN) (SEQ ID NO:706),
T-G-T-(SN)-S-D-V-G-(GS)-Y (SEQ ID NO:707),
(SGQ)-(GS)-(DS)-(NS)-(IL)-(GR)-S-(YKN)-(YS)-(VA) (SEQ ID NO:708),
R-A-S-Q-S-V-S-S-X-L (SEQ ID NO:130),
R-A-S-Q-S-(IV)-S-(SR)-(SY)-(LY)-(ALN) (SEQ ID NO:131), or
R-A-S-(REQ)-(GSTRN)-(IV)-(GSTIRN)-(STIRH)-X1-(SYWNH)-(LV)-(ASN) (SEQ ID NO:132), wherein X1 can be serine or absent;

ii) a LC CDR2 that includes an amino acid sequence as follows:
X-A-S-X-R-A-T (SEQ ID NO:133), wherein X can be any amino acid,
(AGD)-A-S-(STN)-R-A-T (SEQ ID NO:134),
(DG)-(AV)-S-N-(RL)-(AP)-ST) (SEQ ID NO:709),
(AGD)-A-S-(STN)-(LR)-(AEQ)-(ST) (SEQ ID NO:135), or
(AGTKDEH)-A-S-(STN)-(LR)-(AVEQ)-(ST) (SEQ ID NO:136); and iii) a LC CDR3 that includes an amino acid sequence as follows:
Q-Q-(SYFR)-(GSYN)-S-(STYW)-(RP)-(LWRH)-(TIY) (SEQ ID NO:161),
Q-Q-(SYFR)-(GSYN)-S-(STYW)-(RP)-(LWR)-(TIY)-T (SEQ ID NO:137),
(LQ)-Q-(SYFR)-(GSYN)-(SKN)-(STYW)-(RP)-(LWR)-(TIY)-T (SEQ ID NO:138),
Q-Q-X-S-(SN)-(WS)-P-X-T-F (SEQ ID NO:710), wherein X is any amino acid,
Y-(TG)-(SG)-S-(PGS)-(TN)-X-(VT) (SEQ ID NO:711), wherein X is any amino acid,
Q-Q-(YR)-(GS)-S-(SW)-P-R-X1-T (SEQ ID NO:139), wherein X1 is any amino acid or absent,
(LQ)-(LQ)-(SYFRD)-(GSYN)-(STRKN)-(STYWF)-(RP)-(ILMWRH)-(TIY)-(TI) (SEQ ID NO:140), or
(LQ)-(LRQ)-(SYFRD)-(GSYN)-(ASTRKN)-(STYWF)-(SVRP)-(STILMWRH)-(TIY)-(STI) (SEQ ID NO:141), In one embodiment, the light chain variable domain sequence includes one or more of the following properties:

i) a LC CDR1 that includes an amino acid sequence as follows:
S-X-(ND)-(IV)-(AG)-X1-X2-X3 (SEQ ID NO:142), or
T-(GR)-(ST)-S-X5-(ND)-(IV)-(AG)-X1-X2-X3-Y-X4-S (SEQ ID NO:143), wherein X1 is any amino acid (e.g., G or R), X2 is any amino acid (e.g., Y or N), X3 is any amino acid (e.g., F, N, or K), X4 is any amino acid (e.g., aliphatic, e.g., V or A);

ii) a LC CDR2 that includes an amino acid sequence as follows:
(DE)-V-N-N-R-P-S (SEQ ID NO:144)
(DE)-(VD)-(STDN)-(YRDN)-R-P-S (SEQ ID NO:145);

iii) a LC CDR3 that includes an amino acid sequence as follows:
(SQ)-S-(SY)-(ASID)-(GSR)-(ST)-(STRN)-(STYR)-(ATLY)-(SVWQ) (SEQ ID NO:146).

In one embodiment, the HC CDR2 includes an amino acid sequence as follows: (GSVW)-I-(SY)-P-SG-G-(AGVMYW-PQH)-T-(AGSTLVMYFKH)-Y-(AT)-D-S-V-K-G (SEQ ID NO:147) or (GSV)-I-(SY)-P-SG-G-(WQ)-T-(GY)-Y-(AT)-D-S-V-K-G (SEQ ID NO:148).

In one embodiment, the protein includes HC CDR1 and HC CDR2 sequences that are related to the corresponding CDR sequences of p-F3, E3 or E3b. For example, the protein includes the sequence MYGM (SEQ ID NO:149), at a position corresponding to HC CDR1. The sequence can be followed by a small amino acid, e.g., glycine, alanine, valine, or serine. In another example, the protein the sequence VISPSGGX$_1$TX$_2$YADSAVKG (SEQ ID NO:150), at a position corresponding to HC CDR2. For example, X$_1$ can be a hydrophilic amino acid, e.g., glutamine or asparagine. For example, X$_2$ can be a small amino acid, e.g., glycine, alanine, valine, or serine.

In one embodiment, the heavy chain variable domain sequence can have one or more of the following features: the amino acid residue at Kabat position 31 is A, H, K, N, Q, R, S, or T, e.g., H, N, R, or S; the amino acid residue at Kabat position 32 is Y; the amino acid residue at Kabat position 33 is G, K, P, R, or V, e.g., K or V; the amino acid residue at Kabat position 34 is M; the amino acid residue at Kabat position 35 is A, G, H, I, L, M, S, or V, e.g., G, H, M, or V; the amino acid residue at Kabat position 50 is G, R, S, or V, e.g., S or V; the amino acid residue at Kabat position 51 is I; the amino acid residue at Kabat position 52 is S or Y, e.g., Y; the amino acid residue at Kabat position 52a is P or S, e.g., P; the amino acid residue at Kabat position 53 is S; the amino acid residue at Kabat position 54 is G; the amino acid residue at Kabat position 55 is G; the amino acid residue at Kabat position 56 is A, F, H, I, Q, W, or Y, e.g., A, W or Y; the amino acid residue at Kabat position 57 is T; the amino acid residue at Kabat position 58 is R, S, T, or Y, e.g., Y. In one embodiment, the length of CDR3 is between 8-18 amino acids, e.g., between 8-12, 8-10, or 15-17 amino acids.

In one embodiment, two or three of the CDRs of the HC variable domain sequence match motifs that also match a HC variable domain of an antibody described herein. Similarly, in one embodiment, two or three of the CDRs of the LC variable domain sequence match motifs that also match a LC variable domain of an antibody described herein. In still another embodiment, the matched motifs for the CDRs are based on a HC and a LC that are paired in an antibody described herein.

In one embodiment, the H1 and H2 hypervariable loops have the same canonical structure as an antibody described herein. In one embodiment, the L1 and L2 hypervariable loops have the same canonical structure as an antibody described herein.

In one embodiment, the HC CDR1 amino acid sequences have a length of at least 5 amino acids of which at least 3, 4, or 5 amino acids are identical to the CDR1 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the HC CDR2 amino acid sequences have a length of at least 15, 16, or 17 amino acids of which at least 10, 12, 14, 15, 16, or 17 amino acids are identical to the CDR2 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the HC CDR2 amino acid sequences have a length of at least 17 amino acids of which at least 14, 15, 16, or 17 amino acids are identical to the CDR2 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D1, s-E11, s-G10, s-H4, or another antibody described herein. In one embodiment, the HC CDR3 amino acid sequences have a length of at least of at least 7 or 8 amino acids of which at least 5, 6, 7, or 8 amino acids are identical to the CDR3 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, two or three of the CDRs of the HC variable domain sequence match motifs described herein such that the motifs are a set of motifs that match a HC variable domain of a clone described herein, e.g., E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. For example, the protein may include SEQ ID NO:118 and SEQ ID NO:160, e.g., motifs that match the E3 HC variable domain.

In one embodiment, the LC CDR1 amino acid sequences have a length of at least 10, 11, or 12 amino acids of which at least 7, 8, 9, 10, or 11 amino acids are identical to the CDR1 sequence of the LC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the LC CDR2 amino acid sequences have a length of at least 6 or 7 amino acids of which at least 5, 6, or 7 amino acids are identical to the CDR2 sequence of the LC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the LC CDR3 amino acid sequences have a length of at least of at least 8, 9, or 10 amino acids of which at least 7, 8, 9, or 10 amino acids are identical to the CDR3 sequence of the LC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, two or three of the CDRs of the LC variable domain sequence match motifs described herein such that the motifs are a set of motifs that match a LC variable domain of a clone described herein, e.g., E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. For example, the protein may include SEQ ID NO:132, SEQ ID NO:136, and SEQ ID NO:161, e.g., motifs that match the E3 LC variable domain.

In one embodiment, the amino acid sequence of the HC variable domain sequence is at least 70, 80, 85, 90, 92, 95, 97, 98, 99, or 100% identical to the amino acid sequence of the HC variable domain of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the amino acid sequence of the LC variable domain sequence is at least 70, 80, 85, 90, 92, 95, 97, 98, 99, or 100% identical to the amino acid sequence of the LC variable domain of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the amino acid sequences of the HC and LC variable domain sequences are at least 70, 80, 85, 90, 92, 95, 97, 98, 99, or 100% identical to the amino acid sequences of the HC and LC variable domains of a clone selected from the group consisting of E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, and any other antibody described herien.

In one embodiment, the amino acid sequences of one or more framework regions (e.g., FR1, FR2, FR3, and/or FR4) of the HC and/or LC variable domain are at least 70, 80, 85, 90, 92, 95, 97, 98, 99, or 100% identical to corresponding framework regions of the HC and LC variable domains of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the amino acid sequences of the HC and LC variable domain sequences comprise a sequence encoded by a nucleic acid that hybridizes (e.g., under high stringency) to a nucleic acid encoding a variable domain of E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the light chain variable domain sequence is human or non-immunogenic in a human. In one embodiment, the heavy chain variable domain sequence is human or non-immunogenic in a human.

The protein can bind to cells that express Tie1, e.g., endothelial cells. In one embodiment, the protein does not substantially bind (e.g., does not detectably bind) to platelets (e.g., resting and/or activated platelets).

In one embodiment, the protein inhibits tube formation by HUVECs in vitro. For example, the E3 antibody inhibits tube formation by HUVECs in vitro (e.g., under conditions described in Example 18). In one embodiment, the protein inhibits angiogenesis in an in vivo MATRIGEL™ plug assay. For example, the E3 antibody can inhibit angiogenesis in an exemplary assay (see, e.g., an exemplary assay described in Example 21)

In one embodiment, the protein recognizes melanoma-associated structures in a histological section, e.g., not only melanoma tissue, but antigen in surrounding structures. In one embodiment, the protein does not stain blood vessels in normal skin in a histological section.

In one embodiment, the protein specifically binds to Tie1, e.g., it binds with at least a 10, 50, 100, $10^3$, or $10^4$ fold preference for Tie1 relative to another human protein, e.g., Tie2, a natural protein other than Tie1 that has a Ig-like domain, an EGF-like domain, or fibronectin Type III repeat, or human serum albumin. In one embodiment, the protein binds to a domain of Tie1 described herein.

In another aspect, the invention features a protein (e.g., an isolated protein) that modulates activity of Tie1, e.g., the Tie1 receptor. For example, the protein is not naturally occurring. In one embodiment, the protein includes a HC and LC immunoglobulin variable domain sequence. In one embodiment, one or more of the CDRs of the heavy and/or light chain variable domain sequence are human, primate, non-rodent (e.g., non-mouse or non-rat), or synthetic. In one embodiment, one or more of the framework regions of the heavy and/or light chain variable domain sequence are human, primate, or non-rodent (e.g., non-mouse or non-rat). In another embodiment, the protein is substantially free of an immunoglobulin variable domain, e.g., the protein includes a peptide that independently interacts with Tie1 or a polypeptide that does not include a immunoglobulin variable domain.

In one embodiment, the protein activates an activity of the Tie1 protein, e.g., an activity in the Tie1/EpoR chimeric BAF cell assay described in Example 2. A protein that activates in this assay can behave as antagonists in other conditions, for example, in vivo.

In one embodiment, the protein includes the HC and LC immunoglobulin variable domains of the E3, E3b, or other antibody, HC and/or LC immunoglobulin variable domain sequences that are at least 70, 80, 85, 90, 91, 92, 93, 94, 95, 96, 97, 98, 99, or 100% identical in the CDR regions to the respective CDRs of the E3, E3b or other antibody described herein. In one embodiment, the protein competes with E3, E3b, or other antibody described herein for binding to Tie1 or binds to an epitope that overlaps an epitope that is recognized by E3, E3b, or other antibody described herein, or that has at least one, two or three residues in common with an epitope that is recognized by E3, E3b, or other antibody described herein.

In one embodiment, the activating protein enables IL-3 dependent cells that express a chimeric receptor including the Tie1 extracellular domain and the EpoR intracellular domain to survive in the absence of IL-3.

In one embodiment, the protein can cause dimerization of Tie1. In one embodiment, the protein can cause auto-phosphorylation of the RTK domain of Tie1.

In one embodiment, the protein synergizes with the E3 or E3b antibody to activate an activity of Tie, e.g., in the Tie1/EpoR chimeric BAF cell assay. In one embodiment, the protein includes the HC and LC immunoglobulin variable domains of the G2 or C7 antibody or domains that are at least 70, 80, 85, 90, 91, 92, 93, 94, 95, 96, 97, 98, 99, or 100% identical in the CDR regions. In one embodiment, the protein competes with G2 or C7 for binding to Tie1 or binds to an epitope that overlaps an epitope that is recognized by G2 or C7 or that has at least one, two or three residues in common with an epitope that is recognized by G2 or C7.

In another embodiment, the protein antagonizes an activity of the Tie1 protein. For example, the protein can at least partially inhibit the ability of the E3 or E3b antibody to agonize the Tie protein. In one embodiment, the protein can at least partially inhibit the ability of the E3 or E3b antibody to enable IL-3 dependent cells that express a chimeric receptor including the Tie1 extracellular domain and the EpoR intracellular domain to survive in the absence of IL-3.

In one embodiment, the HC and LC immunoglobulin variable domain sequences of the protein include the amino acid sequences that are at least 70, 80, 85, 90, 91, 92, 93, 94, 95, 96, 97, 98, 99, or 100% identical to the amino acid sequences of respective immunoglobulin variable domains of B2 or D11.

In one embodiment, the Tie1 binding protein includes the HC and LC immunoglobulin variable domains of an antibody selected from the group consisting of: B2, D11, A2, A10, P-B1, P-B3, and P-C6 or immunoglobulin domains that are at least 70, 80, 85, 90, 91, 92, 93, 94, 95, 96, 97, 98, 99, or 100% identical in the CDR regions to the CDR regions of the respective antibodies. For example, the protein binds with an affinity $K_D$ of less than $10^{-8}$ M, $5 \cdot 10^{-9}$ M, $10^{-9}$ M, $10^{-10}$ M, $10^{-11}$ M, or $10^{-12}$ M.

In one embodiment, the protein can at least partially inhibit the ability of a naturally occurring Tie1 binding protein from interacting with the Tie protein.

The protein can include other features described herein.

In another aspect, the invention features an antibody (e.g., an isolated antibody) that binds to the Tie1 ectodomain, but does not substantially bind to platelets, e.g., as detected by fluorescence activated cell sorting. For example, the antibody does not substantially bind to activated platelets and/or resting platelets. In one embodiment, the antibody binds to endothelial cells. In one embodiment, the protein is a monoclonal antibody. The antibody can be provided in a preparation that is free of other Tie1-binding antibodies that have other specificities, e.g., free of Tie1 binding antibodies that bind to platelets. The antibody can include other features described herein.

In another aspect, the invention features a protein (e.g., an isolated protein) that preferentially binds to a Tie1 protein in a conformation stabilized by the E3 or E3b antibody relative to an endogenous Tie1 protein in an unstimulated state. In one embodiment, the protein includes immunoglobulin HC and LC domains. In another embodiment, the protein includes a peptide (e.g., of length less than 30, 28, 25, 22, 20, 18, 16, or 14 amino acids) that independently binds to Tie1. For example, the peptide can include one, two, or three disulfide bonds. The protein can include other features described herein.

In another aspect, the invention features a protein (e.g., an isolated protein) that preferentially binds to a Tie1 protein in a dimeric conformation relative to a monomeric Tie1 protein. In one embodiment, the protein includes immunoglobulin HC and LC domains. In another embodiment, the protein includes a peptide (e.g., of length less than 30, 28, 25, 22, 20, 18, 16, or 14 amino acids) that independently binds to Tie1. For example, the peptide can include one, two, or three disulfide bonds. The protein can include other features described herein.

In another aspect, the invention features a protein (e.g., an isolated protein) that preferentially binds to a Tie2 protein in a conformation that is biased against interaction with Ang or Tie1. In one embodiment, the protein includes immunoglobulin HC and LC domains. In another embodiment, the protein includes a peptide (e.g., of length less than 30, 28, 25, 22, 20, 18, 16, or 14 amino acids) that independently binds to Tie2. For example, the peptide can include one, two, or three disulfide bonds. The protein can include other features described herein. The invention also features nucleic acid aptamers that have one or more of these properties.

In another aspect, the invention features a protein (e.g., an isolated protein) that preferentially binds to a Ang protein, and modulates (e.g., inhibits) interaction with Tie1 Tie2. In one embodiment, the protein includes immunoglobulin HC and LC domains. In another embodiment, the protein includes a peptide (e.g., of length less than 30, 28, 25, 22, 20, 18, 16, or 14 amino acids) that independently binds to Ang. For example, the peptide can include one, two, or three disulfide bonds. The protein can include other features described herein. The invention also features nucleic acid aptamers that have one or more of these properties.

In another aspect, the invention features a protein (e.g., an isolated protein) that binds to an epitope of Tie1 ectodomain with a $K_D$ of less than $2 \times 10^{-7}$ M. The epitope overlaps, is within, or includes an epitope bound by E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein or that includes at least one, two, or three residues in common. For example, the protein binds with an affinity $K_D$ of less than $10^{-8}$ M, $5 \cdot 10^{-9}$ M, $10^{-9}$ M, $10^{-10}$ M, $10^{-11}$ M, or $10^{-12}$ M. In one embodiment, the protein includes immunoglobulin HC and LC domains. In another embodiment, the protein includes a peptide (e.g., of length less than 30, 28, 25, 22, 20, 18, 16, or 14 amino acids) that independently binds to Tie1. For example, the peptide can include one, two, or three disulfide bonds. The protein can include other features described herein. The invention also features nucleic acid aptamers that have one or more of these properties.

In another aspect, the invention features a protein (e.g., an isolated protein) that competitively inhibits binding of E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein to a Tie1 ectodomain. In one embodiment, the protein includes immunoglobulin HC and LC domains. In another embodiment, the protein includes a peptide (e.g., of length less than 30, 28, 25, 22, 20, 18, 16, or 14 amino acids) that independently binds to Tie1. For example, the peptide can include one, two, or three disulfide bonds. The protein can include other features described herein.

In another aspect, the invention features a protein (e.g., an isolated protein) that includes a heavy chain immunoglobulin variable domain sequence and a light chain immunoglobulin variable domain sequence and that antagonizes an activity of the Tie1 ectodomain. In one embodiment, CDR1 of the light chain variable domain sequence includes: Q-S-X-S-S (SEQ ID NO:151) or R-A-S-Q-S-X-S-S-Y-L-A (SEQ ID NO:152), wherein X is any amino acid or optionally aliphatic, e.g., isoleucine or valine. In one embodiment, CDR2 of the light chain variable domain sequence includes: A-S-$X_1$-R-$X_2$-T (SEQ ID NO:153) or D-A-S-$X_1$-R-$X_2$-T (SEQ ID NO:154), wherein $X_1$ is any amino acid or optionally a hydrophilic amino acid, e.g., serine or asparagine, and $X_2$ is any amino acid or optionally aliphatic or small aliphatic, e.g., alanine or valine. In one embodiment, CDR3 of the light chain variable domain sequence includes: Q-R-S-$X_2$-W-P-R (SEQ ID NO:155) or $X_1$-Q-R-S-$X_2$-W-P-R-T (SEQ ID NO:156), wherein $X_1$ is any amino acid or optionally leucine or glutamine, and $X_2$ is any amino acid or optionally lysine or semme.

In one embodiment, the protein competes with the B2 and/or D11 antibody for binding to Tie1 or competitively inhibits binding of B2 and/or D11 to Tie1.

In one embodiment, the protein antagonizes a Tie1 activity that is stimulated by the E3 or E3b antibody. In one embodiment, the protein inhibits dimerization of Tie1. The protein can include other features described herein.

In another aspect, the invention features an isolated, monospecific protein including a heavy chain immunoglobulin variable domain sequence and a light chain immunoglobulin variable domain sequence, wherein the protein binds to Tie1 ectodomain and includes a human or non-mouse constant domain (e.g., a human IgG1, IgG2, IgG3, or IgG4 constant domain). The protein can include other features described herein.

In another aspect, the invention features an isolated, human antibody that binds to a Tie1 ectodomain. The protein can include other features described herein.

In another aspect, the invention features an isolated antibody (e.g., an isolated antibody) that binds to a Tie1 ectodomain and contains less than 5, 4, 3, or 2 peptides (of between 6-9 amino acid length) that are non-human in origin or less than 5, 4, 3, or 2 peptides that are potential human T cell epitopes. In one embodiment, the antibody contains no peptide (of 6-9 amino acid length) that is non-human in origin or that is a potential human T cell epitope.

In one embodiment, the antibody is obtained by a method that includes deimmunization. For example, the antibody is deimmunized, e.g., completely deimmunized. The protein can include other features described herein.

In another aspect, the invention features an isolated antibody that binds to a Tie1 ectodomain and that includes a modified Fc domain, e.g., a modified human Fc domain. For example, antibodies may include modifications, e.g., that alter Fc function. For example, the human IgG1 constant region can be mutated at one or more residues, e.g., one or more of residues 234 and 237, e.g., according to the number in U.S. Pat. No. 5,648,260. Other exemplary modifications include those described in U.S. Pat. No. 5,648,260. The protein can include other features described herein.

In another aspect, the invention features an isolated protein that binds to the Tie1 receptor with an affinity $K_D$ of less than $10^{-7}$ M, $10^{-8}$ M, $5 \cdot 10^{-9}$ M, $10^{-9}$ M, $10^{-10}$ M, $10^{-11}$ M, or $10^{-12}$ M. The protein can include other features described herein.

In another aspect, the invention features an isolated protein including a heavy chain immunoglobulin variable domain sequence and a light chain immunoglobulin variable domain sequence, wherein the protein binds to Tie1 ectodomain and, for example, includes at least one or more CDR's that are a non-primate CDR (e.g., a non-mouse or non-rabbit CDR) or a synthetic CDR. The protein can include other features described herein.

In another aspect, the invention features an isolated nucleic acid including a coding sequence that encodes a polypeptide including an immunoglobulin HC variable domain of an antigen binding protein that binds to Tie1. The polypeptide can include one or more other features described herein.

In one embodiment, the nucleic acid further includes a second coding sequence that encodes a polypeptide including an immunoglobulin HC variable domain, e.g., an HC domain described herein. In one embodiment, the nucleic acid further includes a promoter operably linked to the coding sequence.

In another aspect, the invention features a nucleic acid that includes one or more coding sequence that encodes one or more polypeptide chains that collectively include an immunoglobulin HC or LC variable domain of an antigen binding protein that binds to Tie1. In one embodiment, the nucleic acid segment encoding at least one of the variable domains hybridizes to a nucleic acid described herein, e.g., under stringent conditions (e.g., high stringency conditions), e.g., it hybridizes to a region encoding a variable domain and is at least 80, 85, 90, 95, or 98% of the length of such a region. The nucleic acid can include other features described herein.

In another aspect, the invention features a host cell that contains a first nucleic acid sequence encoding a polypeptide including a HC variable domain of an antigen binding protein and a second nucleic acid sequence encoding a polypeptide including a LC variable domain of the antigen binding protein, wherein the antigen binding protein binds to Tie1 with a $K_D$ of less than $2 \times 10^{-7}$ M. In one embodiment, the HC or LC variable domain includes at least one human CDR. The antigen binding protein can include other features described herein.

In another aspect, the invention features a host cell that contains a first nucleic acid encoding a polypeptide including a HC variable region and a second nucleic acid encoding a polypeptide including a LC variable region, wherein the HC and the LC variable regions each include at least 70, 80, 85, 90, 92, 95, 97, 98, 99, or 100% identical to respective amino acid sequences of the HC and LC variable domains of a clone selected from the group consisting of E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E1, s-G10, and s-H4. The antigen binding protein can include other features described herein.

In another aspect, the invention features a pharmaceutical composition including a protein described herein that interacts with Tie1 and a pharmaceutically acceptable carrier.

In another aspect, the invention features a therapeutic composition including a protein described herein that interacts with Tie1 wherein the composition is sterile and suitable for administration to a subject.

In another aspect, the invention features a method that includes: providing a signal-dependent or signal-responsive cell that expresses a chimeric receptor including the Tie1 extracellular domain and a heterologous intracellular sequence that can produce a signal; contacting a candidate compound to the cell; and evaluating a property of the cell that is dependent on the signal. In one embodiment, the intracellular sequence includes at least a region of an intracellular sequence of the EpoR protein. The method can be used, e.g., to evaluate activity of a candidate compound, or a plurality of compounds.

In another aspect, the invention features a method that includes: providing an IL-3 dependent cell that expresses a chimeric receptor including the Tie1 extracellular domain and the EpoR intracellular domain; contacting a candidate compound to the cell under conditions in which the concentration of IL-3 is not sufficient to sustain viability of the cell; and evaluating a property of the cell. The method can be used, e.g., to evaluate activity of a candidate compound, or a plurality of compounds. In one embodiment, the property is viability. In one embodiment, the evaluating includes an MTT assay. In one embodiment, the method further includes administering the candidate compound to a subject. For example, the candidate compound includes a protein, e.g., a protein that includes an immunoglobulin variable domain.

In another aspect, the invention features method of identifying a compound that modulates Tie1 activity. The method includes: providing a plurality of candidate compounds; and evaluating each compound of the plurality using a method described herein.

In another aspect, the invention features a culture cell that expresses a chimeric transmembrane protein including a region of the Tie1 extracellular domain and a heterologous intracellular sequence. In one embodiment, the intracellular sequence includes a region of the EpoR intracellular domain. In one embodiment, the cell requires IL-3 or Tie 1 for viability. For example, the cell is IL-3 dependent in the absence of the chimeric transmembrane protein, but is viable in the presence of the E3 or E3b antibody and the absence of IL-3.

In another aspect, the invention features a preparation that includes the isolated mammalian cells (e.g., cells that expresses a chimeric transmembrane protein including a region of the Tie1 extracellular domain and a heterologous intracellular sequence) and a Tie1-binding protein, wherein the Tie1-binding protein is necessary to sustain viability of the cells.

In another aspect, the invention features a kit including: a Tie1-binding protein and a culture cell that expresses a chimeric transmembrane protein including a region of the Tie1 extracellular domain and a heterologous intracellular sequence.

In another aspect, the invention features a method of evaluating a candidate compound. The method includes: providing a preparation that includes (i) a cell or membrane fraction that contains (a) an insoluble protein that includes a region of the Tie1 extracellular domain and a kinase domain and (b) ATP; (ii) a ligand that causes alters activity of the kinase domain; and (iii) the candidate compound; and evaluating phosphorylation state of the insoluble protein.

In another aspect, the invention features a method of evaluating a candidate compound. The method includes: providing a preparation that includes (i) a cell or membrane fraction that includes a Tie1 protein or a transmembrane protein that includes at least a region of the Tie1 extracellular domain and ATP; (ii) a ligand that causes autophosphorylation of Tie1 or the transmembrane protein; and (iii) the candidate compound; and evaluating phosphorylation state of the Tie1 protein.

In one embodiment, the ligand is an antibody. In one embodiment, the ligand includes the HC and LC immunoglobulin variable domains of the E3 or E3b antibody or domains that are at least 90% identical in the CDR regions. In one embodiment, the method further includes administering the candidate compound to a subject.

In another aspect, the invention features a method that includes: providing a preparation that includes (i) a cell or membrane fraction that includes a transmembrane protein that includes at least a region of the Tie1 extracellular domain and ATP; and (ii) a ligand that causes autophosphorylation of Tie1 or the transmembrane protein; and evaluating phosphorylation state of the transmembrane protein.

In another aspect, the invention features a method that includes: contacting a mammalian cell with a ligand that (i) can agonize Tie1 autophosphorylation and/or (ii) can enable an IL-3 dependent cell that expresses a chimeric receptor including the Tie1 extracellular domain and the EpoR intracellular domain to remain viable under conditions in which the concentration of IL-3 is not sufficient to sustain viability of the cell; and evaluating the mammalian cell. In one embodiment, the cell expresses an endogenous Tie1 protein. In one embodiment, the cell is an endothelial cell. In one embodiment, the method further includes contacting the mammalian cell with a test compound, other than the ligand. For example, the ligand is an antibody. For example, the ligand includes the HC and LC immunoglobulin variable domains of the E3 or E3b antibody or domains that are at least 90% identical in the CDR regions.

In another aspect, the invention features a method that includes: contacting a mammalian cell or fraction thereof with an agent that can modulate the activity of Tie1; and evaluating the mammalian cell or fraction thereof. In one embodiment, the agent is contacted to the cell while the cell is living, and the evaluating includes isolating a fraction of the cell. In one embodiment, the agent is a protein, e.g., an antibody or a peptide. In one embodiment, the agent includes the HC and LC immunoglobulin variable domains of the E3 or E3b antibody or domains that are at least 90% identical in the CDR regions to the E3 or E3b antibody. In one embodiment, the agent includes the HC and LC immunoglobulin variable domains of the B2 or D11 antibody or domains that are at least 90% identical in the CDR regions to the B2 or D11 antibody. In one embodiment, the agent includes the HC and LC immunoglobulin variable domains of the A2, A10, P-B1, P-B3, or P-C6 antibody or domains that are at least 70, 80, 85, 90, 91, 92, 93, 94, 95, 96, 97, 98, 99, or 100% identical % identical in the CDR regions to the A2, A10, P-B1, P-B3, or P-C6 antibody. In one embodiment, the agent includes the HC and LC immunoglobulin variable domains of the G2 or C7 antibody or domains that are at least 90% identical in the CDR regions to the G2, or C7 antibody. The agent can include other features described herein.

In another aspect, the invention features a method of evaluating a test compound, The method includes evaluating interaction between an agent that can modulate the activity of Tie1 and a protein that includes at least a region of the Tie1 extracellular domain in the presence of the test compound. In one embodiment, the agent is a test compound is a small organic compound with molecular weight less than 8000, 7000, 6000, 5000, or 3000 Daltons. For example, the evaluating includes contacting cells that include the protein that includes at least a region of the Tie1 extracellular domain with the agent in the presence of the test compound. In another example, the evaluating includes forming a cell-free preparation that includes the protein that includes at least a region of the Tie1 extracellular domain, the agent, and the test compound.

In another aspect, the invention features an artificial protein complex that includes (i) a protein that includes a Tie1 extracellular domain and (ii) a Tie1 binding protein that can modulate (e.g., agonize or antagonize) an activity of Tie1. In one embodiment, the ligand is an antibody (e.g., an antibody described herein. For example, the ligand includes the HC and LC immunoglobulin variable domains of an antibody selected from the group consisting of: E3, E3b, B2, D11, A2, A10, P-B1, P-B3, P-C6, G2 and C7, or immunoglobulin domains that are at least 90% identical in the CDR regions to the CDR regions of the respective antibody. In one embodiment, the complex is present in a membrane fraction, on a mammalian cell, and/or in a subject.

In another aspect the invention features a method that includes: administering a composition that includes a protein that interacts with Tie1, Tie2, or Ang (e.g., a protein described herein) to a subject in an amount effective to reduce angiogenesis in the subject.

For example, the protein binds to Tie1, Tie2, or Ang with an affinity $K_D$ of less than $10^{-8}$M, $5 \cdot 10^{-9}$ M, $10^{-9}$ M, $10^{-10}$ M, $10^{-11}$M, or $10^{-12}$ M.

In one embodiment, the protein competes with E3 or E3b for binding to Tie1 or binds to an epitope that overlaps the epitope bound by E3 or E3b on Tie1.

In one embodiment, the protein comprises a heavy chain immunoglobulin variable domain sequence and a light chain immunoglobulin variable domain sequence. The protein further includes one or more of the following properties:
(1) at least one of the variable domain sequences comprising at least one CDR of the E3 or E3b antibody;
(2) at least one of the variable domain sequences comprising CDR sequences at least 85% identical, in sum, to the CDRs of the corresponding variable domain of the E3 or E3b antibody,
(3) at least one of the variable domains is at least 85% identical to the corresponding immunoglobulin variable domains of the E3 or E3b antibody, and
(4) the protein competes with E3 or E3b for binding to Tie1 or binds to an epitope that overlaps the epitope bound by E3 or E3b on Tie1.

In one embodiment, one or more of the CDRs of the heavy and/or light chain variable domain sequence are human, primate, non-rodent (e.g., non-mouse or non-rat), or synthetic. In one embodiment, one or more of the framework regions of the heavy and/or light chain variable domain sequence are human, primate, or non-rodent (e.g., non-mouse or non-rat).

In one embodiment, the heavy chain includes one or more of the following properties:
i) a HC CDR1 that includes an amino acid sequence as follows:
(AGSR)-Y-(GVK)-M-(GSVF), (SEQ ID NO:117)
(AGSIMRH)-Y-(GVMK)-M-(GSVMFH) (SEQ ID NO:118), or
(AGSIMRNH)-Y-(AGTVMKPQ)-M-(AGSTVMYW-FKH) (SEQ ID NO:119);
ii) a HC CDR2 that includes an amino acid sequence as follows:
X-I-Y-P-S-G-G-X-T-X-Y-A-D-S-V-K-G (SEQ ID NO:120), wherein X is any amino acid,
(GSV)-I-(SY)-P-S-G-G-(WQ)-T-(GY) (SEQ ID NO:121),
(GSV)-I-(SY)-P-S-G-G-(WQ)-T-(GY)-Y-A-D-S-V-K-G (SEQ ID NO:122),
(GSVW)-I-(SY)-P-S-G-G-(AGVMYWPQH)-T-(AG-STLVMYFKH) (SEQ ID NO:123); or
X-I-Y-P-S-G-G-(WPS)-T-(YVH)-Y-A-D (SEQ ID NO:704), wherein X is any amino acid;
iii) a HC CDR3 that includes an amino acid sequence as follows:
V-(four or five residues)-F-D-(I/Y) (SEQ ID NO:124),
G-Y-G-P-I-A-P-G-L-D-Y (SEQ ID NO:125),
(GV)-N-Y-Y-(GYD)-S-(SD)-G-Y-G-P-I-A-P-G-L-D-Y (SEQ ID NO:126),
(GVD)-(AGLN)-(LYR)-(GSTLYH)-(GYD)-(AGSYFP)-(SFD)-(AGYD)-(IY)-(GFD)-(YDP)-(IP)-A-P-G-L-D-Y (SEQ ID NO:127),
VNYYDSSGYGPIAPGLDY (SEQ ID NO:128), or
G-X-X-G-(AY)-F-D-(YI) (SEQ ID NO:705), wherein X is any amino acid.

In one embodiment, the light chain includes one or more of the following properties:
i) a LC CDR1 that includes an amino acid sequence as follows:
R-A-S-Q-S-(IV)-S-(SR)-X1-Y-L-(AN) (SEQ ID NO:129),
R-A-S-Q-S-(IV)-S-S-(YS)-L-(ALN) (SEQ ID NO:706),
T-G-T-(SN)-S-D-V-G-(GS)-Y (SEQ ID NO:707),
(SGQ)-(GS)-(DS)-(NS)-(IL)-(GR)-S-(YKN)-(YS)-(VA) (SEQ ID NO:708),
R-A-S-Q-S-V-S-S-X-L (SEQ ID NO:130),
R-A-S-Q-S-(IV)-S-(SR)-(SY)-(LY)-(ALN) (SEQ ID NO:131), or R-A-S-(REQ)-(GSTRN)-(IV)-(GSTIRN)-(STIRH)-X1-(SYWNH)-(LV)-(ASN) (SEQ ID NO:132), wherein X1 can be serine or absent;

ii) a LC CDR2 that includes an amino acid sequence as follows:

X-A-S-X-R-A-T (SEQ ID NO:133), wherein X can be any amino acid, (AGD)-A-S-(STN)-R-A-T (SEQ ID NO:134), (DG)-(AV)-S-N-(RL)-(AP)-ST) (SEQ ID NO:709), (AGD)-A-S-(STN)-(LR)-(AEQ)-(ST) (SEQ ID NO:135), or (AGTKDEH)-A-S-(STN)-(LR)-(AVEQ)-(ST) (SEQ ID NO:136); and iii) a LC CDR3 that includes an amino acid sequence as follows:

Q-Q-(SYFR)-(GSYN)-S-(STYW)-(RP)-(LWR)-(TIY)-T (SEQ ID NO:137), (LQ)-Q-(SYFR)-(GSYN)-(SKN)-(STYW)-(RP)-(LWR)-(TIY)-T (SEQ ID NO:138),

Q-Q-X-S-(SN)-(WS)-P-X-T-F (SEQ ID NO:710), wherein X is any amino acid,

Y-(TG)-(SG)-S-(PGS)-(TN)-X-(VT) (SEQ ID NO:711), wherein X is any amino acid,

Q-Q-(YR)-(GS)-S-(SW)-P-R-X1-T (SEQ ID NO:139), wherein X1 is any amino acid or absent, (LQ)-(LQ)-(SYFRD)-(GSYN)-(STRKN)-(STYWF)-(RP)-(ILMWRH)-(TIY)-(TI) (SEQ ID NO:140), or (LQ)-(LRQ)-(SYFRD)-(GSYN)-(ASTRKN)-(STYWF)-(SVRP)-(STILMWRH)-(TIY)-(STI) (SEQ ID NO:141).

In one embodiment, the heavy chain includes one or more of the following properties:

i) a HC CDR1 that includes an amino acid sequence as follows:

(AGSIMRH)-Y-(GVMK)-M-(GSVMFH) (SEQ ID NO:118), or (AGSIMRNH)-Y-(AGTVMKPQ)-M-(AGSTVMYW-FKH) (SEQ ID NO:119);

ii) a HC CDR2 that includes an amino acid sequence as follows:

(GSV)-I-(SY)-P-S-G-G-(NWQ)-T-(GY) (SEQ ID NO:160), (GSV)-I-(SY)-P-S-G-G-(NWQ)-T-(GY)-Y-A-D-S-V-K-G (SEQ ID NO:122), or (GSVW)-I-(SY)-P-S-G-G-(AGVMYWPQH)-T-(AG-STLVMYFKH) (SEQ ID NO:123);

iii) a HC CDR3 that includes an amino acid sequence as follows:

APRGYSYGYYY (SEQ ID NO:712).

In one embodiment, the light chain includes one or more of the following properties:

i) a LC CD R1 that includes an amino acid sequence as follows:

R-A-S-(REQ)-(GSTRN)-(IV)-(GSTIRN)-(STIRH)-X1-(SYWNH)-(LV)-(ASN) (SEQ ID NO:132), wherein X1 can be serine or absent;

ii) a LC CDR2 that includes an amino acid sequence as follows:

(TAGD)-A-S-(STN)-(LR)-(AEQ)-(ST) (SEQ ID NO:713), or (AGTKDEH)-A-S-(STN)-(LR)-(AVEQ)-(ST) (SEQ ID NO:136); and iii) a LC CDR3 that includes an amino acid sequence as follows:

Q-Q-(SYFR)-(GSYN)-S-(STYW)-(RP)-(LHWR)-(TIY) (SEQ ID NO:714), (LQ)-Q-(SYFR)-(GSYN)-(SKN)-(STYW)-(RP)-(LHWR)-(TIY) (SEQ ID NO:715), or (LQ)-(LQ)-(SYFRD)-(GSYN)-(STRKN)-(STYWF)-(RP)-(ILMWRH)-(TIY) (SEQ ID NO:716).

In one embodiment, the light chain includes one or more of the following properties:

i) a LC CDR1 that includes an amino acid sequence as follows:

S-X-(ND)-(IV)-(AG)-X1-X2-X3 (SEQ ID NO:142), or

T-(GR)-(ST)-S-X5-(ND)-(IV)-(AG)-X1-X2-X3-Y-X4-S (SEQ ID NO:143), wherein X1 is any amino acid (e.g., G or R), X2 is any amino acid (e.g., Y or N), X3 is any amino acid (e.g., F, N, or K), X4 is any amino acid (e.g., aliphatic, e.g., V or A);

iii) a LC CDR2 that includes an amino acid sequence as follows:

(DE)-V-N-N-R-P-S (SEQ ID NO:144);

(DE)-(VD)-(STDN)-(YRDN)-R-P-S (SEQ ID NO:145);

v) a LC CDR3 that includes an amino acid sequence as follows:

(SQ)-S-(SY)-(ASID)-(GSR)-(ST)-(STRN)-(STYR)-(ATLY)-(SVWQ) (SEQ ID NO:146).

In one embodiment, the HC CDR2 includes an amino acid sequence as follows: (GSVW)-I-(SY)-P-SG-G-(AGVMYW-PQH)-T-(AGSTLVMYFKH)-Y-(AT)-D-S-V-K-G (SEQ ID NO:147) or (GSV)-I-(SY)-P-SG-G-(WQ)-T-(GY)-Y-(AT)-D-S-V-K-G (SEQ ID NO:148).

In one embodiment, the HC CDR1 amino acid sequences have a length of at least 5 amino acids of which at least 3, 4, or 5 amino acids are identical to the CDR1 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D 11, s-E11, s-G10, s-H4, or another antibody described herein. In one embodiment, the HC CDR2 amino acid sequences have a length of at least 15, 16, or 17 amino acids of which at least 10, 12, 14, 15, 16, or 17 amino acids are identical to the CDR2 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the HC CDR2 amino acid sequences have a length of at least 17 amino acids of which at least 14, 15, 16, or 17 amino acids are identical to the CDR2 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the HC CDR3 amino acid sequences have a length of at least of at least 7 or 8 amino acids of which at least 5, 6, 7, or 8 amino acids are identical to the CDR3 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the LC CDR1 amino acid sequences have a length of at least 10, 11, or 12 amino acids of which at least 7, 8, 9, 10, or 11 amino acids are identical to the CDR1 sequence of the LC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the LC CDR2 amino acid sequences have a length of at least 6 or 7 amino acids of which at least 5, 6, or 7 amino acids are identical to the CDR2 sequence of the LC of clone E3, E3b, G2, p-A1, p-A10, p-B1, p-B3, p-C6, p-D12, p-F3, p-F4, p-G3, s-A10, s-H1, s-A2, s-B2, s-C10, s-C2, s-C7, s-D11, s-E11, s-G10, s-H4, or another antibody described herein. In one embodiment, the LC CDR3 amino acid sequences have a length of at least of at least 8, 9, or 10 amino acids of which at least 7, 8, 9, or 10 amino acids are identical to the CDR3 sequence of the LC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the amino acid sequence of the HC variable domain sequence is at least 70, 80, 85, 90, 92, 95, 97, 98, 99, or 100% identical to the amino acid sequence of the HC variable domain of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the amino acid sequence of the LC variable domain sequence is at least 70, 80, 85, 90, 92, 95, 97, 98, 99, or 100% identical to the amino acid sequence of the LC variable domain of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the amino acid sequences of the HC and LC variable domain sequences are at least 70, 80, 85, 90, 92, 95, 97, 98, 99, or 100% identical to the amino acid sequences of the HC and LC variable domains of a clone selected from the group consisting of E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, and s-H4.

In one embodiment, the amino acid sequences of one or more framework regions (e.g., FR1, FR2, FR3, and/or FR4) of the HC and/or LC variable domain are at least 70, 80, 85, 90, 92, 95, 97, 98, 99, or 100% identical to corresponding framework regions of the HC and LC variable domains of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the light chain variable domain sequence is human or non-immunogenic in a human. In one embodiment, the heavy chain variable domain sequence is human or non-immunogenic in a human.

The protein can bind to cells that express Tie1, e.g., endothelial cells. In one embodiment, the protein does not substantially bind (e.g., does not detectably bind) to platelets.

In one embodiment, the protein specifically binds to Tie1, e.g., it binds with at least a 10, 50, 100, $10^3$, or $10^4$ fold preference for Tie1 relative to another human protein, e.g., Tie2, a natural protein other than Tie1 that has a Ig-like domain, an EGF-like domain, or fibronectin Type III repeat, or human serum albumin. In one embodiment, the protein binds to a domain of Tie1 described herein.

In one embodiment, the protein is delivered locally. In one embodiment, the protein is delivered systemically.

In one embodiment, the subject is in need of reduced angiogenesis, or identified as such. For example, the subject has an angiogenesis-related disorder. In another example, the subject has a neoplastic disorder, e.g., a metastatic cancer. For example, the subject has an angiogenesis-dependent cancer or tumor.

In another embodiment, the subject has an inflammatory disorder, e.g., rheumatoid arthritis or psoriasis.

In one embodiment, the protein is administered in an amount effective to reduce one or more of the following activities: sprouting, splitting and remodeling of blood vessels. In one embodiment, the protein is administered in an amount effective to reduce vasculogenesis or tubule formation.

In one embodiment, the method further includes, prior to the administering, identifying the subject as a subject in need of reduced angiogenesis. In one embodiment, the method further includes administering the protein continuously or in separate boluses. In one embodiment, the method further includes monitoring the subject during the course of administration. For example, the monitoring includes imaging blood vessels (locally or throughout) the subject. For example, the imaging includes administering the same or different Tie1-binding protein to the subject.

In another aspect the invention features a method that includes: administering a composition that includes a protein described herein (e.g., a protein that reduces a Tie1 activity) to a subject in an amount effective to reduce a Tie1 activity in the subject. The method can include other features described herein.

In another aspect, the invention features a method that includes administering a composition that includes a protein described herein that modulates an activity of Tie1 to a subject in an amount effective to modulate Tie1 activity in the subject. In one embodiment, the method includes administering first and second proteins that both interact with Tie1. For example, the first protein that agonizes Tie1 activity and second protein that antagonizes Tie1 activity is administered, e.g., to precisely titrate activity. For example, the first and second protein can be administered to different locations to inhibit angiogenesis in one area without affecting another area.

In one embodiment, the first and second proteins are administered separately. In another embodiment, the first and second proteins are administered as a combination. The method can include other features described herein.

In another aspect the invention features a method that includes: administering a composition that includes a protein described herein (e.g., a protein that can modulate an activity of Tie1) to a subject in an amount effective to modulate endothelial cell activity in the subject. In one embodiment, the protein is delivered into the circulation.

In one embodiment, the composition is effective for sensitizing endothelial cells to a treatment, and providing a treatment to the subject that inhibits, kills, ablates, or otherwise arrests the sensitized endothelial cells.

In another aspect the invention features a method that includes: (i) contacting the sample (and optionally, a reference, e.g., control, sample) with a protein that binds to Tie1, e.g., a protein described herein, under conditions that allow interaction of the Tie1-binding protein and the Tie1 protein to occur; and (ii) detecting formation of a complex between the Tie1-binding protein, and the sample (and optionally, the reference, e.g., control, sample).

In another aspect the invention features a method that includes: (i) administering to a subject (and optionally a control subject) an Tie1-binding protein (e.g., an antibody or antigen binding fragment thereof), under conditions that allow interaction of the Tie1-binding protein and the Tie1 protein to occur; and (ii) detecting formation of a complex between the Tie1-binding protein and a Tie1 molecule of the subject or detecting distribution of the Tie1-binding protein or at least one location of the Tie1-binding protein in the subject. In one embodiment, the Tie1-binding protein does not modulate the activity of Tie1. The Tie1-binding protein can be a protein described herein. In one embodiment, the ligand detects activated Tie1.

An antibody that binds to Tie1 is preferably monospecific, e.g., a monoclonal antibody, or antigen-binding fragment thereof. For example, the antibody can recognize Tie1 on a living cell, e.g., an endogenous Tie1 molecule or a Tie1 molecule that is expressed from a heterologous nucleic acid. In one embodiment, the Tie1-binding protein interacts with primary endothelial cells. The term "monospecific antibody" refers to an antibody that displays a single binding specificity and affinity for a particular target, e.g., epitope. This term includes a "monoclonal antibody" which refers to an antibody that is produced as a single molecular species, e.g., from a population of homogenous isolated cells. A "monoclonal antibody composition" refers to a preparation of antibodies or fragments thereof of in a composition that includes a single molecular species of antibody. In one embodiment, a monoclonal antibody is produced by a mammalian cell. One or more monoclonal antibody species may be combined.

The Tie1-binding antibodies can be full-length (e.g., an IgG (e.g., an IgG1, IgG2, IgG3, IgG4), IgM, IgA (e.g., IgA1, IgA2), IgD, and IgE) or can include only an antigen-binding fragment (e.g., a Fab, F(ab')$_2$ or scFv fragment), e.g., it does not include an Fc domain or a CH2, CH3, or CH4 sequence. The antibody can include two heavy chain immunoglobulins and two light chain immunoglobulins, or can be a single chain antibody. The antibodies can, optionally, include a constant region chosen from a kappa, lambda, alpha, gamma, delta, epsilon or a mu constant region gene. An Tie1-binding antibody can include a heavy and light chain constant region substantially from a human antibody, e.g., a human IgG1 constant region or a portion thereof. As used herein, "isotype" refers to the antibody class (e.g., IgM or IgG1) that is encoded by heavy chain constant region genes.

In one embodiment, the antibody (or fragment thereof) is a recombinant or modified antibody, e.g., a chimeric, a humanized, a deimmunized, or an in vitro generated antibody. The term "recombinant" or "modified" human antibody, as used herein, is intended to include all antibodies that are prepared, expressed, created or isolated by recombinant means, such as antibodies expressed using a recombinant expression vector transfected into a host cell, antibodies isolated from a recombinant, combinatorial antibody library, antibodies isolated from an animal (e.g., a mouse) that is transgenic for human immunoglobulin genes or antibodies prepared, expressed, created or isolated by any other means that involves splicing of human immunoglobulin gene sequences to other DNA sequences. Such recombinant antibodies include humanized, CDR grafted, chimeric, deimmunized, in vitro generated antibodies, and may optionally include constant regions derived from human germline immunoglobulin sequences.

In one embodiment, the antibody binds to an epitope distinct from an epitope bound by known monoclonal antibodies that bind to Tie1, e.g., an antibody described in WO 95/26364, e.g., 3C4C7G6 and 10F11G6. In other embodiments, the antibody does not compete with known monoclonal antibodies that bind to Tie 1, e.g., 3C4C7G6 and 10F11G6. In still other embodiments, the antibody does not compete with ligand described herein.

Also within the scope of the invention are antibodies or other agents (e.g., protein or non-protein agents) that bind overlapping epitopes of, or competitively inhibit the binding of the proteins disclosed herein, e.g., proteins that bind to Tie1, Tie2, or Ang. For example, the antibodies or other agents bind overlapping epitopes of or competitively inhibit the binding of monospecific antibodies, e.g., E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein to Tie1, or vice versa (e.g., the monospecific antibodies competitively inhibiting binding of the ligands). Overlapping epitopes can include at least one amino acid in common. Agents that competitively inhibit binding of one another do not necessarily bind to overlapping epitopes. For example, they may inhibit binding by steric interference or by altering the conformation of Tie1.

Any combination of binding proteins is within the scope of the invention, e.g., two or more antibodies that bind to different regions of Tie1, Tie2, or Ang, e.g., antibodies that bind to two different epitopes on the extracellular domain of Tie1, Tie2, or Ang, e.g., a bispecific antibody.

In one embodiment, the Tie1-binding antibody or antigen-binding fragment thereof includes at least one light or heavy chain immunoglobulin (or preferably, at least one light chain immunoglobulin and at least one heavy chain immunoglobulin). Preferably, each immunoglobulin includes a light or a heavy chain variable region having at least one, two and, preferably, three complementarity determining regions (CDR's) substantially identical to a CDR from an anti-Tie1 light or heavy chain variable region, respectively, i.e., from a variable region of an antibody described herein, e.g., E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one aspect, the invention features an agent (e.g., an antibody) that decreases endothelial cell activity by increasing Tie1 phosphorylation. In one embodiment, the agent decreases endothelial cell differentiation, e.g., sprouting, splitting, and tube formation.

In one aspect, the invention features an agent (e.g., an antibody) that decreases endothelial cell activity by activating a signaling pathway. In one embodiment, the antibody decreases endothelial cell differentiation, e.g., sprouting, splitting, and tube formation. This agent-induced effect can be independent or dependent of Tie1 self-association.

In one aspect, the invention features an isolated protein that includes a heavy chain immunoglobulin variable domain sequence and a light chain immunoglobulin variable domain sequence, wherein the protein binds to Tie1 ectodomain and the heavy chain immunoglobulin variable domain sequence includes one or more of the following properties:

i) a HC CDR1 that includes an amino acid sequence of a clone from the group consisting of: M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09; M0045-A02; M0045-A04; M0045-B01; M0045-B03; M0045-B1; M0045-C02; M0045-C1; M0045-C12; M0045-D01; M0045-D07; M0045-G01; M0045-G10; M0046-A11; M0046-B06; M0046-B10; M0046-G12; M0046-H03; M0046-H10; M0046-H11; M0047-B03; M0047-D01; M0047-D03; M0047-E10; M0047-G09; M0053-A02; M0053-A03; M0053-AOS; M0053-A09; M0053-B09; M0053-B11; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01;

M0056-A06; M0056-B08; M0056-B09; M0056-C03;
M0056-C04; M0056-E08; M0056-F01; M0056-F02;
M0056-F10; M0056-F11; M0056-G03; M0056-G04;
M0056-G08; M0056-G12; M0056-H04; M0056-H12;
M0057-B05; M0057-H07; M0058-A09; M0058-D04;
M0058-E09; M0058-F03; M0058-G03; M0058-H01;
M0059-A02; M0059-A06; M0060-B02; M0060-H01;
M0061-A03; M0061-C05; M0061-C06; M0061-F07;
M0061-G12; M0061-H09; M0062-A12; M0062-B05;
M0062-B07; M0062-C08; M0062-D04; M0062-E02;
M0062-E03; M0062-E11; M0062-F10; M0062-G06;
and M0062-H01, or a sequence that is at least 70, 75, 80, 85, or 90% identical to such a sequence;

ii) a HC CDR2 that includes an amino acid sequence of a clone from the group consisting of: M0044-A06; M0044-A1; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H11; M0047-B03; M0047-D01; M0047-D03; M0047-E10; M0047-G09; M0053-A02; M0053-A03; M0053-A05; M0053-A09; M0053-B09; M0053-B11; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F11; M0056-G03; M0056-G04; M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M00661-G12; M0061-H09; M0062-A12; M0062-B05; M0062-B07; M0062-C08; M0062-D04; M0062-E02; M0062-E03; M0062-E11; M0062-F10; M0062-G06; and M0062-H01, or a sequence that is at least 70, 75, 80, 85, or 90% identical to such a sequence;

iii) a HC CDR3 that includes an amino acid sequence of a clone from the group consisting of: M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H11; M0047-B03; M0047-D01; M0047-D03; M0047-E10; M0047-G09; M0053-A02; M0053-A03; M0053-A05; M0053-A09; M0053-B09; M0053-B11; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F11; M0056-G03; M0056-G04; M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C0$_5$; M0061-C06; M0061-F07; M0061-G12; M0061-H09; M0062-A12; M0062-B05; M0062-B07; M0062-C08; M0062-D04; M0062-E02; M0062-E03; M0062-E11; M0062-F10; M0062-G06; and M0062-H01, or a sequence that is at least 70, 75, 80, 85, or 90% identical to such a sequence.

In one embodiment, the protein also includes the light chain immunoglobulin variable domain sequence which includes one or more of the following properties:

i) a LC CDR1 that includes an amino acid sequence of a clone from the group consisting of: M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H$_{11}$; M0047-B03; M0047-D01; M0047-D03; M0047-E10; M0047-G09; M0053-A02; M0053-A03; M0053-A05; M0053-A09; M0053-B09; M0053-B11; M0053-D03; M0053-D06; M0053-D 12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-CO$_5$; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F11; M0056-G03; M0056-G04; M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M0061-G12; M0061-H09; M0062-A12; M0062-B05; M0062-B07; M0062-C08; M0062-D04; M0062-E02; M0062-E03; M0062-E11; M0062-F10; M0062-G06; and M0062-H01, or a sequence that is at least 70, 75, 80, 85, or 90% identical to such a sequence;

ii) a LC CDR2 that includes an amino acid sequence of a clone from the group consisting of: M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09;

M0045-A02; M0045-A04; M0045-B01; M0045-B03; M0045-B1; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H11; M0047-B03; M0047-D01; M0047-D03; M0047-E10; M0047-G09; M0053-A02; M0053-A03; M0053-A05; M0053-A09; M0053-B09; M0053-B11; M0053-D03; M0053-D06; M0053-D12; M0053-E03; M0053-E04; M0053-E08; M0053-F04; M0053-F05; M0053-F06; M0053-F08; M0053-G04; M0053-G5; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F11; M0056-G03; M0056-G04; M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M0061-G12; M0061-H09; M0062-A12; M0062-B05; M0062-B07; M0062-C08; M0062-D04; M0062-E02; M0062-E03; M0062-E11; M0062-F10; M0062-G06; and M0062-H01, or a sequence that is at least 70, 75, 80, 85, or 90% identical to such a sequence;

iii) a LC CDR3 that includes an amino acid sequence of a clone from the group consisting of: M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H11; M0047-B03; M0047-D01; M0047-D03; M0047-E10; M0047-G09; M0053-A02; M0053-A03; M0053-A05; M0053-A09; M0053-B09; M0053-B11; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F11; M0056-G03; M0056-G04; M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M0061-G12; M0061-H09; M0062-A12; M0062-B05; M0062-B07; M0062-C08; M0062-D04; M0062-E02; M0062-E03; M0062-E11; M0062-F10; M0062-G06; and M0062-H01, or a sequence that is at least 70, 75, 80, 85, or 90% identical to such a sequence.

In one embodiment, the protein includes the amino acid sequence of the HC variable domain sequence which is at least 85, 90, 95, 98, or 99% identical to the amino acid sequence of the HC variable domain of clone M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H11; M0047-B03; M0047-D01; M0047-D03; M0047-E10; M0047-G09; M0053-A02; M0053-A03; M0053-A05; M0053-A09; M0053-B09; M0053-B11; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F11; M0056-G03; M0056-G04; M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M0061-G12; M0061-H09; M0062-A12; M0062-B05; M0062-B07; M0062-C08; M0062-D04; M0062-E02; M0062-E03; M0062-E11; M0062-F10; M0062-G06; or M0062-H01.

In one embodiment, the protein includes the amino acid sequence of the LC variable domain sequence which is at least 85, 90, 95, 98, or 99% identical to the amino acid sequence of the LC variable domain of clone M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H11; M0047-B03; M0047-D01; M0047-D03; M0047-E10; M0047-G09; M0053-A02; M0053-A03; M0053-A05; M0053-A09; M0053-B09; M0053-B11; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C0$_5$; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F11; M0056-G03; M0056-G04;

M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M0061-G12; M0061-H09; M0062-A12; M0062-B05; M0062-B07; M0062-C08; M0062-D04; M0062-E02; M0062-E03; M0062-E11; M0062-F10; M0062-G06; or M0062-H01.

A target binding agent (e.g., a Tie1-binding protein, Tie2-binding protein, or Ang binding protein) described herein can be administered to a subject or used in vitro in non-derivatized or unconjugated forms. In other embodiments, the Tie1-binding protein can be derivatized, modified or linked to another functional molecule, e.g., another protein (e.g., HSA, an Fc domain, etc.), a polymer (e.g., PEG) isotope, cell, or insoluble support. For example, the Tie1-binding protein can be functionally linked (e.g., by chemical coupling, genetic fusion, non-covalent association or otherwise) to one or more other molecular entities, such as an antibody (e.g., if the protein is an antibody to form a bispecific or a multi-specific antibody), a toxin, a radioisotope, a therapeutic (e.g., a cytotoxic or cytostatic) agent or moiety, among others. For example, the Tie1-binding protein can be coupled to a radioactive ion (e.g., an $\alpha$-, $\gamma$-, or $\beta$-emitter), e.g., iodine ($^{131}$I or $^{125}$I), yttrium ($^{90}$Y), lutetium ($^{177}$Lu), actinium ($^{225}$Ac), rhenium ($^{186}$Re), or bismuth ($^{212}$Bi or $^{213}$Bi).

In another aspect, the invention features a nucleic acid that includes a coding sequence that encodes a polypeptide comprising an immunoglobulin heavy or light chain variable domain that binds to Tie1, e.g., an immunoglobulin heavy or light chain variable domain described herein. For example, the nucleic acid can include a particular nucleic acid sequence described herein, a nucleic acid that is at least 75, 80, 85, 90, 95, 96, 97, 98, or 99% identical to a nucleic acid sequence described herein (e.g., a particular nucleic acid sequence), or a nucleic acid that specifically hybridizes (e.g., under conditions described herein) to a nucleic acid sequence described herein (e.g., a particular nucleic acid sequence), or fragments thereof (e.g., CDR-coding fragments).

A nucleic acid described herein can further include a promoter operably linked to the coding sequence. A nucleic acid can include a first and second coding sequence, e.g., wherein the first coding sequence encodes a polypeptide that includes an immunoglobulin heavy chain variable domain and the second coding sequence encodes a polypeptide that includes an immunoglobulin light chain variable domain.

In another aspect, the invention features a host cell that contains a first nucleic acid encoding a polypeptide comprising a heavy chain variable region and a second nucleic acid encoding a polypeptide comprising a light chain variable region. The heavy chain variable region and the light chain variable region can associate to form a Tie1 binding protein. These variable regions can have one or more properties described herein, e.g., at least 75, 80, 85, 90, 95, 96, 97, 98, or 99% identity to a sequence described herein. The invention also includes a method of providing a Tie1-binding antibody. The method can include providing a host cell described herein; and expressing said first and second nucleic acids in the host cell under conditions that allow assembly of said light and heavy chain variable regions to form an antigen binding protein that interacts with Tie1.

In another aspect, the invention provides compositions, e.g., pharmaceutical compositions, which include a pharmaceutically acceptable carrier, excipient or stabilizer, and at least one of the Tie1-binding proteins (e.g., antibodies or fragments thereof) described herein. In one embodiment, the compositions, e.g., the pharmaceutical compositions, include a combination of two or more of the aforesaid Tie1-binding proteins.

In another aspect, the invention features a kit that includes an Tie1-binding antibody (or fragment thereof), e.g., an Tie1-binding antibody (or fragment thereof) as described herein, for use alone or in combination with other therapeutic modalities, e.g., a cytotoxic or labeling agent, e.g., a cytotoxic or labeling agent as described herein, along with instructions on how to use the Tie1 antibody or the combination of such agents to treat, prevent or detect a Tie1-related disorder, e.g., an endothelial cell related disorder, e.g., rheumatoid arthritis or metastatic cancer.

In another aspect, the binding protein that binds to Tie1 is a polypeptide that is not an immunoglobulin. For example, the polypeptide can be of variable length, e.g., 4 to 100 amino acid residues in length, preferably 5 to 75, 6 to 50, or 7 to 40 amino acid residues in length, or more preferably 8 to 30 or 10 to 25 amino acid residues in length. In some embodiments, the polypeptide includes non-standard or synthetic amino acid residues, e.g., norleucine, selenocysteine, pyrrolysine, etc. In some embodiments, the polypeptide includes cross-linking groups, e.g., two cysteine residues that can form a disulfide bond or some other type of chemical cross-linking moieties that can be used to cyclize the peptide. In other preferred embodiments, the polypeptide can be modified, e.g., using polyethylene glycol or fusion to a soluble protein, e.g., to increase the solubility or circulatory half-life of the polypeptide.

The target-binding protein can be physically associated with (e.g., fused to) another protein, e.g., a protein that does not bind to the target, e.g., to the amino or carboxy terminus. For example, the target-binding protein can be associated with (e.g,. fused to) a protein that increases serum residence or alters stability, e.g., an albumin, e.g., a serum albumin, e.g., HSA (human serum albumin). In another example, the target binding protein is physically associated with (e.g., fused to) a moiety that facilitates purification, e.g., a purification tag such as His, PEG, or to a functional moiety, e.g., Fc.

In another aspect, the invention features a method of identifying a protein that specifically binds to Tie1. In preferred embodiments, the invention includes: providing a Tie1 antigen; providing a display library (e.g., a phage display library member); identifying a member present in the library, wherein the member expresses a protein that specifically binds to the Tie1 antigen. The term "Tie1 antigen" refers to any antigenic fragment of Tie1 that is at least 8 amino acids in length. For example, a Tie1 antigen can include a fragment of the Tie1 ectodomain, e.g., a fragment that includes a folded protein domain such as a fragment described herein. In some embodiments, the Tie1 antigen is of human origin and includes, e.g., the extracellular domain of human Tie1 or a fragment thereof (e.g., a fragment described herein. The Tie1 antigen can be a recombinant polypeptide optionally fused to another polypeptide, e.g., a Fc domain, or it can be a cell that expresses Tie1 on its surface (e.g., an endothelial cell). In other preferred embodiments, the Tie1 antigen has an activated conformation, e.g., the Tie1 antigen is a dimeric conformation or a conformation stabilized by the E3 or E3b antibody described herein.

The methods described here are, for example, applicable to libraries that are based on bacteriophage with a substantially complete genome (e.g., including a modified gene III) and to libraries that are based on bacteriophage particles that include a phagemid nucleic acid. The terms "bacteriophage library member" and "phage" encompass members of both types of libraries. The term "bacteriophage particle" refers to a particle formed of bacteriophage coat proteins that packages a nucleic acid. The packaged nucleic acid can be a modified bacteriophage genome or a phagemid, e.g., a nucleic acid that includes a bacteriophage origin of replication but lacks essential phage genes and cannot propagate in E. coli without help from "helper phage" or phage genes supplied in trans.

In other embodiments, the invention features a method of identifying a protein that specifically binds to Tie1. The method includes: providing a Tie1 antigen (e.g., an region of the Tie1 ectodomain); immunizing a non-human animal with the Tie1 antigen; and isolating a cell that produces a immunoglobulin that interacts with Tie1. For example, the method can include producing hybridoma cells from the spleen of the animal (e.g., an immunized mouse); and identifying individual hybridoma cell lines expressing an antibody that specifically binds to the Tie1 antigen. For example, the In preferred embodiments, the Tie1 antigen is of human origin and includes, e.g., the extracellular domain of human Tie1 or some fragment thereof, e.g., the HA binding domain of Tie1. The Tie1 antigen can be a recombinant polypeptide optionally fused to another polypeptide, e.g., a purification handle, or it can be a cell that expresses Tie1 (e.g., an endothelial cell) on its surface. In other preferred embodiments, the Tie1 antigen has an activated conformation, e.g., dimerized.

In preferred embodiments, the methods further include isolating a nucleic acid molecule from the identified phage or hybridoma, wherein the nucleic acid molecule encodes the polypeptide or antibody that specifically binds to the Tie1 antigen. The isolated nucleic acid molecules can be used to produce therapeutic agents, as described herein.

In another aspect, the invention features nucleic acids that encode proteins identified by the methods described herein. In preferred embodiments, the nucleic acids include sequences encoding a heavy and light chain immunoglobulin or immunoglobulin fragment described herein. For example, the invention features, a first and second nucleic acid encoding a heavy and light chain variable region, respectively, of an Tie1-binding antibody molecule as described herein. Sequences encoding a heavy and light chain that function together can be present on separate nucleic acid molecules or on the same nucleic acid molecule. In another aspect, the invention features host cells and vectors containing a nucleic acid described herein.

In yet another aspect, the invention features a method of producing an Tie1-binding antibody, or antigen-binding fragment thereof. The method includes: providing a host cell that contains a first nucleic acid encoding a polypeptide comprising a heavy chain variable region, e.g., a heavy chain variable region as described herein; providing a second nucleic acid encoding a polypeptide comprising a light chain variable region, e.g., a light chain variable region as described herein; and expressing said first and second nucleic acids in the host cell under conditions that allow assembly of said light and heavy chain variable regions to form an antigen binding protein that interacts with Tie1. The first and second nucleic acids can be linked or unlinked, e.g., expressed on the same or different vector, respectively. The first and second nucleic acids can be components of the same molecule or can reside on different molecules (e.g., different chromosomes or plasmids).

The host cell can be a eukaryotic cell, e.g., a mammalian cell, an insect cell, a yeast cell, or a prokaryotic cell, e.g., E. coli. For example, the mammalian cell can be a cultured cell or a cell line. Exemplary mammalian cells include lymphocytic cell lines (e.g., NSO), Chinese hamster ovary cells (CHO), COS cells, oocyte cells, and cells from a transgenic animal, e.g., mammary epithelial cell. For example, nucleic acids encoding the antibodies described herein can be expressed in a transgenic animal. In one embodiment, the nucleic acids are placed under the control of a tissue-specific promoter (e.g., a mammary specific promoter) and the antibody is produced in the transgenic animal. For example, the antibody molecule is secreted into the milk of the transgenic animal, such as a transgenic cow, pig, horse, sheep, goat or rodent. To produce a single chain antibody, the nucleic acid is configured to encode a single polypeptide that comprises both the heavy and light chain variable domains.

Tie1 has been found to be overexpressed in association with a wide range of cancers. Targeting Tie1 on the tumor vasculature with Tie1-binding proteins (e.g., antibodies) can be used to inhibit, destroy, or otherwise antagonize the vasculature so that tumor growth and metastasis is reduced. The proteins can be, for example, associated with a toxic payload or can mediate direct functional inhibition.

In another aspect, the invention features a method of inhibiting an activity of a cell, e.g., an endothelial cell, e.g., proliferation, adhesion, growth or survival of a cell, e.g., an endothelial cell, e.g., an endothelial cell in the vicinity of a cancer, e.g., a tumor. Methods of the invention include contacting the cell with a Tie1-binding protein, in an amount sufficient to inhibit the adhesion, migration, growth or proliferation of the cell. Methods of the invention can be used, for example, to treat or prevent a disorder, e.g., an inflammatory disorder (e.g., rheumatoid arthritis, lupus, restenosis, psoriasis, graft v. host response, or multiple sclerosis), or a cancerous disorder (e.g., a malignant or metastatic disorder), by administering to a subject (e.g., an experimental animal or a human patient) a Tie1-binding protein in an amount effective to treat or prevent such disorder. a Tie1-binding protein can also be used to treat or prevent stroke, heart disease, ulcers, scleroderma, infertility, and other diseases that are associated with insufficient angiogenesis.

A Tie1-binding protein can be used to treat or prevent angiogenesis-related disorders, particularly angiogenesis-dependent cancers and tumors.

Angiogenesis-related disorders include, but are not limited to, solid tumors; tumor metastasis; benign tumors (e.g., hemangiomas, acoustic neuromas, neurofibromas, trachomas, and pyogenic granulomas; rheumatoid arthritis); psoriasis; ocular angiogenic diseases, for example, diabetic retinopathy, retinopathy of prematurity, macular degeneration, corneal graft rejection, neovascular glaucoma, retrolental fibroplasia, rubeosis; Osler-Webber Syndrome; myocardial angiogenesis; plaque neovascularization; telangiectasia; hemophiliac joints; angiofibroma; and wound granulation.

"Angiogenesis-dependent cancers and tumors" are cancers tumors that require, for their growth (expansion in volume and/or mass), an increase in the number and density of the blood vessels supplying then with blood. In one embodiment a Tie1-binding protein causes regression of such cancers and tumors. "Regression" refers to the reduction of tumor mass and size, e.g., a reduction of at least 2, 5, 10, or 25%.

In another aspect, the invention features a method of contacting a cell (in vitro, ex vivo, or in vivo), e.g., an endothelial cell, e.g., an endothelial cell in the vicinity of a cancer, e.g., a tumor. The method can include providing an agent (e.g., a protein) that interacts with Tie1, e.g., a protein described herein, and contacting the cell with the protein, in an amount sufficient to form at least one detectable ligand-cell complex. The protein can include, for example, a label or cytotoxic entity, e.g., an immunoglobulin Fc domain or a cytotoxic drug.

In another aspect, the invention features a method of treating, e.g., inhibiting, ablating or killing, a cell or impairing at least one activity of the cell. The method includes providing a Tie1-binding protein, e.g. a ligand described herein, and contacting the cell with the protein, in an amount sufficient to impair at least one activity of the cell, inhibit, ablate or kill the cell. The contacting can be in vitro or in vivo. For example, the cell can be, e.g., an endothelial cell, e.g., an endothelial cell in the vicinity of a cancer, e.g., a tumor. The protein can include a cytotoxic entity. Methods of the invention can be used, for example, to treat or prevent a disorder, e.g., a endothelial cell-based disorder, a blood vessel disorder, wound healing, or a cancerous disorder (e.g., a malignant or metastatic disorder), by administering to a subject (e.g., an experimental animal or a human patient) an Tie1-binding protein in an amount effective to treat or prevent such disorder.

The subject methods can be used on cells in culture, e.g. in vitro or ex vivo. For example, an endothelial cell, e.g., an endothelial cell in cancer biopsy, can be cultured in vitro in culture medium and the contacting step can be effected by adding the Tie1-binding protein to the culture medium. The method can be performed on cells (e.g., cancerous or metastatic cells) present in a subject, as part of an in vivo (e.g., therapeutic or prophylactic) protocol. For in vivo embodiments, the contacting step is effected in a subject and includes administering the Tie1-binding protein to the subject under conditions effective to permit both binding of the protein to the cell, and the inhibition of adhesion, migration, growth or proliferation of the cell.

The method of the invention can be used to treat or prevent cancerous disorders, e.g., including but are not limited to, solid tumors, soft tissue tumors, and metastatic lesions, particularly tumors that require a blood supply or angiogenesis. Examples of solid tumors include malignancies, e.g., sarcomas, adenocarcinomas, and carcinomas, of the various organ systems, such as those affecting lung, breast, lymphoid, gastrointestinal (e.g., colon), and genitourinary tract (e.g., renal, urothelial cells), pharynx, as well as adenocarcinomas which include malignancies such as most colon cancers, rectal cancer, renal-cell carcinoma, liver cancer, non-small cell carcinoma of the lung, cancer of the small intestine and cancer of the esophagus. The subject can be a mammal, e.g., a primate, preferably a higher primate, e.g., a human (e.g., a patient having, or at risk of, a disorder described herein, e.g., an endothelial cell-based disorder, e.g., cancer).

The Tie1-binding antibody or fragment thereof, e.g., an Tie1-binding antibody or fragment thereof as described herein, can be administered to the subject systemically (e.g., orally, parenterally, subcutaneously, intravenously, intramuscularly, intraperitoneally, intranasally, transdermally, or by inhalation), topically, or by application to mucous membranes, such as the nose, throat and bronchial tubes.

The methods can further include the step of monitoring the subject, e.g., for a reduction in one or more of: a reduction in tumor size; reduction in cancer markers, e.g., levels of cancer specific antigen; reduction in the appearance of new lesions, e.g., in a bone scan; a reduction in the appearance of new disease-related symptoms; or decreased or stabilization of size of soft tissue mass; or any parameter related to improvement in clinical outcome. The subject can be monitored in one or more of the following periods: prior to beginning of treatment; during the treatment; or after one or more elements of the treatment have been administered. Monitoring can be used to evaluate the need for further treatment with the same Tie1-binding protein or for additional treatment with additional agents. Generally, a decrease in one or more of the parameters described above is indicative of the improved condition of the subject. Information about the monitoring can be recorded, e.g., in electronic or digital form.

The Tie1-binding protein can be used alone in unconjugated form to thereby inhibit adhesion, migration, or extravasation or the Tie1-expressing cells, or ablate or kill the Tie1-expressing cells. If the Tie1-binding protein is an antibody, the ablation or killing can be mediated, e.g., by an antibody-dependent cell killing mechanisms such as complement-mediated cell lysis and/or effector cell-mediated cell killing. In other embodiments, the Tie1-binding protein can be bound (e.g., physically associated, either directly or indirectly, covalently or non-covalently) to a substance, e.g., a cytotoxic agent or moiety, effective to kill or ablate the Tie1-expressing cells. For example, the Tie1-binding protein can be coupled to a radioactive ion (e.g., an α-, γ-, or β-emitter), e.g., iodine ($^{131}$I or $^{125}$I), yttrium ($^{90}$Y), lutetium ($^{177}$Lu), actinium ($^{225}$Ac), or bismuth ($^{212}$Bi or $^{213}$Bi). The methods and compositions of the invention can be used in combination with other therapeutic modalities. In one embodiment, the methods of the invention include administering to the subject an Tie1-binding protein, e.g., an Tie1-binding antibody or fragment thereof, in combination with a cytotoxic agent, in an amount effective to treat or prevent said disorder. The Tie1-binding protein and the cytotoxic agent can be administered simultaneously or sequentially. In other embodiments, the methods and compositions of the invention are used in combination with surgical and/or radiation procedures.

In another aspect, the invention features methods for detecting the presence of a Tie1 protein or a cell expressing Tie1 (e.g., an endothelial cell) in a sample, in vitro (e.g., a biological sample, a tissue biopsy, e.g., a cancerous lesion). The subject method can be used to evaluate, e.g., diagnose or stage a disorder described herein, e.g., a cancerous disorder. The method includes: (i) contacting the sample (and optionally, a reference, e.g., control sample) with an Tie1-binding protein, as described herein, under conditions that allow interaction of the Tie1-binding protein and the Tie1 protein to occur; and (ii) detecting formation of a complex between the Tie1-binding protein, and the sample (and optionally, the reference, e.g., control, sample). Formation of the complex is indicative of the presence of Tie1 protein (e.g., activated Tie1 protein), and can indicate the suitability or need for a treatment described herein. For example, a statistically significant change in the formation of the complex in the sample relative to the reference sample, e.g., the control sample, is indicative of the presence of Tie1 (e.g., activated Tie1) in the sample.

In yet another aspect, the invention provides a method for detecting the presence of Tie1 (e.g., activated Tie1) in vivo (e.g., in vivo imaging in a subject). The subject method can be used to evaluate, e.g., diagnose, localize, or stage a disorder described herein, e.g., a cancerous disorder. The method includes: (i) administering to a subject (and optionally a control subject) an Tie1-binding protein (e.g., an antibody or antigen binding fragment thereof), under conditions that allow interaction of the Tie1-binding protein and the Tie1 protein to occur; and (ii) detecting formation of a complex between the Tie1-binding protein and Tie1, wherein a statistically significant change in the formation of the complex in the subject relative to the reference, e.g., the control subject or subject's baseline, is indicative of the presence of the Tie1. The presence of activated Tie1 in particular locations within a subject can be indicative of an endothelial-cell related disorder, e.g., an angiogenesis-related disorder, e.g., a cancer, e.g., metastatic cancer, or other angiogenesis-related disorder described herein.

In other embodiments, a method of diagnosing or staging, a disorder as described herein (e.g., an inflammatory or cancerous disorder), is provided. The method includes: (i) identifying a subject having, or at risk of having, the disorder; (ii)

obtaining a sample of a tissue or cell affected with the disorder; (iii) contacting said sample or a control sample with an Tie1-binding protein, under conditions that allow interaction of the binding agent and the Tie1 protein to occur, and (iv) detecting formation of a complex. A statistically significant increase in the formation of the complex between the Tie1-binding protein with respect to a reference sample, e.g., a control sample, is indicative of the disorder or the stage of the disorder. For example, the finding of activated Tie1 on tumor cells located in a solid tumor can indicate that the tumor is progressing into a metastatic tumor.

Preferably, the Tie1-binding protein used in the in vivo and in vitro diagnostic methods is directly or indirectly labeled with a detectable substance to facilitate detection of the bound or unbound binding agent. Suitable detectable substances include various enzymes, prosthetic groups, fluorescent materials, luminescent materials and radioactive materials. In one embodiment, the Tie1-binding protein is coupled to a radioactive ion, e.g., indium ($^{111}$In), iodine ($^{131}$I or $^{125}$I), yttrium ($^{90}$Y), actinium ($^{225}$Ac), bismuth ($^{212}$Bi or $^{213}$Bi), sulfur ($^{35}$S), carbon ($^{14}$C), tritium ($^{3}$H), rhodium ($^{188}$Rh), or phosphorous ($^{32}$P). In another embodiment, the Tie1-binding protein is labeled with an NMR contrast agent.

In one aspect, the invention features a method of imaging tumor vasculature, the method includes: providing a protein that binds to Tie1, Tie2, or Ang, e.g., a protein described herein, wherein the protein is physically associated to an imaging agent; administering the protein to a patient, e.g., with a tumor; and imaging the patient, e.g., to detect tumor vasculature.

In one aspect, the invention features a method of treating a subject with a blood born neoplastic disorder, the method includes administering a protein that binds to Tie1, Tie2, or Ang, e.g., a protein described herein, to a subject with a blood born neoplastic disorder (e.g., a proliferative disorder of hematopoietic cells, e.g., leukemia), thereby treating the disorder.

In one aspect, the invention features a method of diagnosing and treating a subject, the method includes evaluating a parameter associated with Tie1, Tie2, or Ang in a subject; and, if the parameter is altered relative to a reference, administering a protein described herein to the subject, thereby treating the subject. In one embodiment, the parameter includes a value indicative of protein or mRNA levels, e.g., in a tissue of a subject. In one embodiment, the reference includes a value determined for a reference subject, e.g., an age/gender matched subject, e.g., a control or normal subject.

In one aspect, the invention features a method of treating a subject, the method includes: administering a protein described herein to a subject that has elevated Tie1, Tie2, or Ang biomolecules or activity relative to a reference. The method can include evaluating the subject, e.g., to determine if the subject has elevated Tie1, Tie2, or Ang biomolecules or activity relative to a reference. In one embodiment, the subject has elevated Tie1 protein or mRNA levels.

The invention also provides polypeptides and nucleic acids that encompass a range of amino acid and nucleic acid sequences, e.g., sequences described herein or sequences related to those described herein. For example, the invention features nucleic acids that encodes each of the polypeptides described herein. The nucleic acid can include the cognate codons or any set of codons that can be translated to produce the respective polypeptide. Such polypeptides include individual subunits of a multi-chain protein, e.g., an antibody that includes a plurality of different polypeptide chains. The nucleic acid may also be a nucleic acid fragment or vector that is not expressed, but includes a sequence encoding at least a part of an immunoglobulin variable region (e.g., including a CDR described herein) or a complement thereof. Such nucleic acids can be used to prepare useful constructs, cells, and proteins. In addition, the invention features a host cell that includes a nucleic acid described herein. The cell can express a protein described herein, e.g., on its surface. The invention also includes are proteins that include an amino acid sequence encoded by a nucleic acid described herein or that hybridize to a nucleic acid described herein.

As used herein, the term "antibody" refers to a protein that includes at least one immunoglobulin variable domain or immunoglobulin variable domain sequence. For example, an antibody can include a heavy (H) chain variable region (abbreviated herein as VH), and a light (L) chain variable region (abbreviated herein as VL). In another example, an antibody includes two heavy (H) chain variable regions and two light (L) chain variable regions. The term "antibody" encompasses antigen-binding fragments of antibodies (e.g., single chain antibodies, Fab fragments, F(ab')$_2$, a Fd fragment, a Fv fragments, and dAb fragments) as well as complete antibodies.

The VH and VL regions can be further subdivided into regions of hypervariability, termed "complementarity determining regions" ("CDR"), interspersed with regions that are more conserved, termed "framework regions" (FR). The extent of the framework region and CDR's has been precisely defined (see, Kabat, E. A., et al. (1991) *Sequences of Proteins of Immunological Interest, Fifth Edition*, U.S. Department of Health and Human Services, NIH Publication No. 91-3242, and Chothia, C. et al. (1987) J. Mol. Biol. 196:901-917). Kabat definitions are used herein. Each VH and VL is typically composed of three CDR's and four FR's, arranged from amino-terminus to carboxy-terminus in the following order: FR1, CDR1, FR2, CDR2, FR3, CDR3, FR4.

An "immunoglobulin domain" refers to a domain from the variable or constant domain of immunoglobulin molecules. Immunoglobulin domains typically contain two β-sheets formed of about seven β-strands, and a conserved disulphide bond (see, e.g., A. F. Williams and A. N. Barclay 1988 *Ann. Rev Immunol.* 6:381-405). The canonical structures of hypervariable loops of an immunoglobulin variable can be inferred from its sequence, as described in Chothia et al. (1992) *J. Mol. Biol.* 227:799-817; Tomlinson et al. (1992) *J. Mol. Biol.* 227: 776-798); and Tomlinson et al. (1995) *EMBO J.* 14(18):4628-38.

As used herein, an "immunoglobulin variable domain sequence" refers to an amino acid sequence which can form the structure of an immunoglobulin variable domain. For example, the sequence may include all or part of the amino acid sequence of a naturally-occurring variable domain. For example, the sequence may omit one, two or more N- or C-terminal amino acids, internal amino acids, may include one or more insertions or additional terminal amino acids, or may include other alterations. In one embodiment, a polypeptide that includes immunoglobulin variable domain sequence can associate with another immunoglobulin variable domain sequence to form a target binding structure (or "antigen binding site"), e.g., a structure that interacts with Tie1, e.g., binds to or inhibits Tie1.

The VH or VL chain of the antibody can further include all or part of a heavy or light chain constant region, to thereby form a heavy or light immunoglobulin chain, respectively. In one embodiment, the antibody is a tetramer of two heavy immunoglobulin chains and two light immunoglobulin chains, wherein the heavy and light immunoglobulin chains are inter-connected by, e.g., disulfide bonds. The heavy chain constant region includes three domains, CH1, CH2 and CH3. The light chain constant region includes a CL domain. The variable region of the heavy and light chains contains a binding domain that interacts with an antigen. The constant regions of the antibodies typically mediate the binding of the antibody to host tissues or factors, including various cells of the immune system (e.g., effector cells) and the first component (Clq) of the classical complement system. The term "antibody" includes intact immunoglobulins of types IgA, IgG, IgE, IgD, IgM (as well as subtypes thereof). The light chains of the immunoglobulin may be of types kappa or lambda. In one embodiment, the antibody is glycosylated. An antibody can be functional for antibody-dependent cytotoxicity and/or complement-mediated cytotoxicity.

One or more regions of an antibody can be human or effectively human. For example, one or more of the variable regions can be human or effectively human. For example, one or more of the CDRs can be human, e.g., HC CDR1, HC CDR2, HC CDR3, LC CDR1, LC CDR2, and LC CDR3. Each of the light chain CDRs can be human. HC CDR3 can be human. One or more of the framework regions can be human, e.g., FR1, FR2, FR3, and FR4 of the HC or LC. In one embodiment, all the framework regions are human, e.g., derived from a human somatic cell, e.g., a hematopoietic cell that produces immunoglobulins or a non-hematopoietic cell. In one embodiment, the human sequences are germline sequences, e.g., encoded by a germline nucleic acid. One or more of the constant regions can be human or effectively human. In another embodiment, at least 70, 75, 80, 85, 90, 92, 95, or 98% of the framework regions (e.g., FR1, FR2, and FR3, collectively, or FR1, FR2, FR3, and FR4, collectively) or the entire antibody can be human or effectively human. For example, FR1, FR2, and FR3 collectively can be at least 70, 75, 80, 85, 90, 92, 95, 98, or 99% identical to a human sequence encoded by a human germline V segment of a locus encoding a light or heavy chain sequence.

All or part of an antibody can be encoded by an immunoglobulin gene or a segment thereof. Exemplary human immunoglobulin genes include the kappa, lambda, alpha (IgA1 and IgA2), gamma (IgG1, IgG2, IgG3, IgG4), delta, epsilon and mu constant region genes, as well as the myriad immunoglobulin variable region genes. Full-length immunoglobulin "light chains" (about 25 Kd or 214 amino acids) are encoded by a variable region gene at the NH2-terminus (about 110 amino acids) and a kappa or lambda constant region gene at the COOH-terminus. Full-length immunoglobulin "heavy chains" (about 50 Kd or 446 amino acids), are similarly encoded by a variable region gene (about 116 amino acids) and one of the other aforementioned constant region genes, e.g., gamma (encoding about 330 amino acids).

The term "antigen-binding fragment" of a full length antibody (or simply "antibody portion," or "fragment"), as used herein, refers to one or more fragments of a full-length antibody that retain the ability to specifically bind to a target of interest. Examples of binding fragments encompassed within the term "antigen-binding fragment" of a full length antibody include (i) a Fab fragment, a monovalent fragment consisting of the VL, VH, CL and CH1 domains; (ii) a F(ab')$_2$ fragment, a bivalent fragment including two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) *Nature* 341:544-546), which consists of a VH domain; and (vi) an isolated complementarity determining region (CDR) that retains functionality. Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules known as single chain Fv (scFv). See e.g., Bird et al. (1988) *Science* 242:423-426; and Huston et al. (1988) *Proc. Natl. Acad. Sci. USA* 85:5879-5883.

Antibody fragments can be obtained using any appropriate technique including conventional techniques known to those with skill in the art. The term "monospecific antibody" refers to an antibody that displays a single binding specificity and affinity for a particular target, e.g., epitope. This term includes a "monoclonal antibody" or "monoclonal antibody composition," which as used herein refer to a preparation of antibodies or fragments thereof of single molecular composition. As used herein, "isotype" refers to the antibody class (e.g., IgM or IgG1) that is encoded by heavy chain constant region genes.

In one embodiment, the HC or LC of an antibody includes sequences that correspond to an amino acid sequence encoded by a human germline sequence, e.g., the framework regions and/or in the CDRs. For example, the antibody can include sequences from the human DP47 antibody. In one embodiment, one or more codons for the antibody are altered relative to the germline nucleic acid sequence, but are chosen to encode the same amino acid sequence. Codons can be selected, e.g., to optimize expression in a particular system, create restriction enzyme sites, create a silent fingerprint, etc.

In one embodiment, CDR2 of the antibody HC includes at least 11, 12, 13, 14, or 15 amino acid positions that are identical to the amino acids found in CDR2 of DP47.

A "humanized" immunoglobulin variable region is an immunoglobulin variable region that includes sufficient number of human framework amino acid positions such that the immunoglobulin variable region does not elicit an immunogenic response in a normal human. Descriptions of "humanized" immunoglobulins include, for example, U.S. Pat. No. 6,407,213 and U.S. Pat. No. 5,693,762.

An "effectively human" immunoglobulin variable region is an immunoglobulin variable region that includes a sufficient number of human framework amino acid positions such that the immunoglobulin variable region does not elicit an immunogenic response in a normal human. An "effectively human" antibody is an antibody that includes a sufficient number of human amino acid positions such that the antibody does not elicit an immunogenic response in a normal human.

As used herein, "Tie complex" refers to a heteromeric complex that includes Tie1, Tie2, and an angiopoietin (Ang). The Tie complex is formed in part by association of the extracellular domains of Tie1 and Tie2 and also includes Ang. As used herein, "complex members" refers to the proteins that are included in a heteromeric Tie complex. Accordingly, Tie1, Tie2, and Ang are all complex members. The term "Ang" includes all angiopoietins, such as Ang1, Ang2, Ang3, and Ang4. The heteromeric Tie complex can include other proteins in addition to Tie1, Tie2, and Ang. A protein or ligand that antagonizes complex formation inhibits or decreases the association of Tie1, Tie2, or Ang with at least one other member of the complex and thereby decreases Tie2 signaling and downstream effects such as angiogenesis.

As used herein, the terms "agonist" and "antagonist" describe properties in context of a particular activity or effect. For example, the E3 or E3b antibody can be an agonist in the context of promoting Tie1 self-association (e.g., homodimerization), yet an antagonist in the context of decreasing or inhibiting Tie complex formation and tube formation by HUVECs. Likewise, an agent that is an agonist in the context of a Tie1 signaling pathway can be an antagonist in the context of endothelial cell sprouting, splitting, and tube formation.

The term "Tie1 ectodomain" refers to an extracellular region of a Tie1 protein, e.g., a region that includes about amino acids 25-759 of SEQ ID NO:2. Other exemplary regions are regions that include one or more EGF-like domains (e.g., 214-256, 258-303, 303-345, 214-303, 258-345, or 214-345 of SEQ ID NO:2); one or more Ig-Like C2-type domains (e.g., 43-105, 43-426, 372-426); one or more Fibronectin Type III repeats (e.g., 446-540, 543-639, 643-744, 446-639, 543-744, or 446-744 of SEQ ID NO:2); and combinations thereof. The terms "first Ig-like C2-type domain" and "Ig 1" refer to the immunoglobulin-like domain in Tie1 or Tie2 that is located closest to the amino terminus of the protein relative to the other Ig-like C2-type domain (the second such domain). For example, for Tie1, the first Immunoglobulin-like C2-type domain is located at about residue 43 to about residue 105 and the second Ig-like C2-type domain is located at about residue 372 to about residue 426.

As used herein, "binding affinity" refers to the apparent association constant or $K_a$. The $K_a$ is the reciprocal of the dissociation constant ($K_d$). A ligand may, for example, have a binding affinity of at least $10^5$, $10^6$, $10^7$ or $10^8$ $M^{-1}$ for a particular target molecule. Higher affinity binding of a ligand to a first target relative to a second target can be indicated by a higher $K_a$ (or a smaller numerical value $K_d$) for binding the first target than the $K_a$ (or numerical value $K_d$) for binding the second target. In such cases the ligand has specificity for the first target relative to the second target. Differences in binding affinity (e.g., for specificity or other comparisons) can be at least 1.5, 2, 5, 10, 50, 100, or 1000-fold. For example, a Tie1-binding protein may preferentially bind to Tie1 at least 1.5, 2, 5, 10, 50, 100, or 1000-fold better than to another antigen, e.g., Tie2, EGF, fibronectin, or human serum albumin. A Tie1-binding protein may also be species-specific or species-general (e.g., can bind to a Tie1 protein from more than one species).

Binding affinity can be determined by a variety of methods including equilibrium dialysis, equilibrium binding, gel filtration, ELISA, surface plasmon resonance, or spectroscopy (e.g., using a fluorescence assay). These techniques can be used to measure the concentration of bound and free ligand as a function of ligand (or target) concentration. The concentration of bound ligand ([Bound]) is related to the concentration of free ligand ([Free]) and the concentration of binding sites for the ligand on the target where (N) is the number of binding sites per target molecule by the following equation:

$$[Bound] = N \cdot [Free] / ((1/Ka) + [Free])$$

Although quantitative measurements of Ka are routine, it is not always necessary to make an exact determination of $K_a$, though, since sometimes it is sufficient to obtain a qualitative measurement of affinity, e.g., determined using a method such as ELISA or FACS analysis, is proportional to $K_a$, and thus can be used for comparisons, such as determining whether a higher affinity is, e.g., 2, 5, 10, 20, or 50 fold higher than a reference. Binding affinity is typically evaluated in 0.01 M HEPES pH 7.4, 0.15 M NaCl, 3 mM EDTA and 0.005% (v/v) surfactant P20.

An "isolated composition" refers to a composition that is removed from at least 90% of at least one component of a natural sample from which the isolated composition can be obtained. Compositions produced artificially or naturally can be "compositions of at least" a certain degree of purity if the species or population of species of interests is at least 5, 10, 25, 50, 75, 80, 90, 95, 98, or 99% pure on a weight-weight basis.

An "epitope" refers to the site on a target compound that is bound by a ligand, e.g., an antigen-binding protein (e.g., a Fab or antibody). In the case where the target compound is a protein, for example, an epitope may refer to the amino acids that are bound by the ligand. Overlapping epitopes include at least one common amino acid residue.

As used herein, the term "substantially identical" (or "substantially homologous") is used herein to refer to a first amino acid or nucleotide sequence that contains a sufficient number of identical or equivalent (e.g., with a similar side chain, e.g., conserved amino acid substitutions) amino acid residues or nucleotides to a second amino acid or nucleotide sequence such that the first and second amino acid or nucleotide sequences have similar activities. In the case of antibodies, the second antibody has the same specificity and has at least 50% of the affinity of the same.

Sequences similar or homologous (e.g., at least about 85% sequence identity) to the sequences disclosed herein are also part of this application. In some embodiment, the sequence identity can be about 85%, 90%, 91%, 92%, 93%, 94%, 95%, 96%, 97%, 98%, 99% or higher. Alternatively, substantial identity exists when the nucleic acid segments will hybridize under selective hybridization conditions (e.g., highly stringent hybridization conditions), to the complement of the strand. The nucleic acids may be present in whole cells, in a cell lysate, or in a partially purified or substantially pure form.

Calculations of "homology" or "sequence identity" between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence aligned for comparison purposes is at least 30%, preferably at least 40%, more preferably at least 50%, even more preferably at least 60%, and even more preferably at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In a preferred embodiment, the percent identity between two amino acid sequences is determined using the Needleman and Wunsch ((1970) *J. Mol. Biol.* 48:444-453) algorithm which has been incorporated into the GAP program in the GCG software package, using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package, using a NWSgapdna.CMP matrix and a gap weight of 40, 50, 60, 70, or 80 and a length weight of 1, 2, 3, 4, 5, or 6. A particularly preferred set of parameters (and the one that should be used if the practitioner is uncertain about what parameters should be applied to determine if a molecule is within a sequence identity or homology limitation of the invention) are a Blossum 62 scoring matrix with a gap penalty of 12, a gap extend penalty of 4, and a frameshift gap penalty of 5.

As used herein, the term "homologous" is synonymous with "similarity" and means that a sequence of interest differs from a reference sequence by the presence of one or more amino acid substitutions (although modest amino acid insertions or deletions) may also be present. Presently preferred means of calculating degrees of homology or similarity to a reference sequence are through the use of BLAST algorithms (available from the National Center of Biotechnology Information (NCBI), National Institutes of Health, Bethesda Md.), in each case, using the algorithm default or recommended parameters for determining significance of calculated sequence relatedness. The percent identity between two amino acid or nucleotide sequences can also be determined using the algorithm of E. Meyers and W. Miller ((1989) *CABIOS*, 4:11-17) which has been incorporated into the ALIGN program (version 2.0), using a PAM120 weight residue table, a gap length penalty of 12 and a gap penalty of 4.

As used herein, the term "hybridizes under low stringency, medium stringency, high stringency, or very high stringency conditions" describes conditions for hybridization and washing. Guidance for performing hybridization reactions can be found in *Current Protocols in Molecular Biology*, John Wiley & Sons, N.Y. (1989), 6.3.1-6.3.6. Aqueous and nonaqueous methods are described in that reference and either can be used. Specific hybridization conditions referred to herein are as follows: 1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); 2) medium stringency hybridization conditions in 6×SSC at about 45° C., followed by one or more washes in 0.2×SSC, 0.1% SDS at 60° C.; 3) high stringency hybridization conditions in 6×SSC at about 45° C., followed by one or more washes in 0.2×SSC, 0.1% SDS at 65° C.; and 4) very high stringency hybridization conditions are 0.5M sodium phosphate, 7% SDS at 65° C., followed by one or more washes at 0.2×SSC, 1% SDS at 65° C.

It is understood that the proteins described herein may have mutations relative to a particular protein described herein (e.g., a conservative or non-essential amino acid substitutions), which do not have a substantial effect on function. Whether or not a particular substitution will be tolerated, i.e., will not adversely affect desired biological properties, such as binding activity can be determined as described in Bowie, et al. (1990) *Science* 247:1306-1310. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). It is possible, for example, for framework and CDR amino acid residues to include one or more conservative substitutions.

A "non-essential" amino acid residue is a residue that can be altered from the wild-type-sequence of the binding agent, e.g., the antibody, without abolishing or more preferably, without substantially altering a biological activity, whereas an "essential" amino acid residue results in such a change.

Generally, where "X" is used to represent an amino acid residue, any amino acid (e.g., any of the twenty naturally occurring amino acids) can be used at that position, or at least a subset thereof (e.g., any of the nineteen non-cysteine amino acids).

The terms "polypeptide" or "peptide" (which may be used interchangeably) refer to a polymer of three or more amino acids linked by a peptide bond, e.g., between 3 and 30, 12 and 60, or 30 and 300, or over 300 amino acids in length. The polypeptide may include one or more unnatural amino acids. Typically, the polypeptide includes only natural amino acids. A "protein" can include one or more polypeptide chains. Accordingly, the term "protein" encompasses polypeptides. A protein or polypeptide can also include one or more modifications, e.g., a glycosylation, amidation, phosphorylation, and so forth. The term "small peptide" can be used to describe a polypeptide that is between 3 and 30 amino acids in length, e.g., between 8 and 24 amino acids in length.

Statistical significance can be determined by any art known method. Exemplary statistical tests include: the Students T-test, Mann Whitney U non-parametric test, and Wilcoxon non-parametric statistical test. Some statistically significant relationships have a P value of less than 0.05, or 0.02. Particular ligands may show a difference, e.g., in specificity or binding, that are statistically significant (e.g., P value <0.05 or 0.02).

Other features and advantages of the instant invention will become more apparent from the following detailed description and claims. Embodiments of the invention can include any combination of features described herein. In no case does the term "embodiment" exclude one or more other features disclosed herein, e.g., in another embodiment.

The contents of all references, pending patent applications and published patents, cited throughout this application are hereby expressly incorporated by reference.

DETAILED DESCRIPTION

Figure 1:
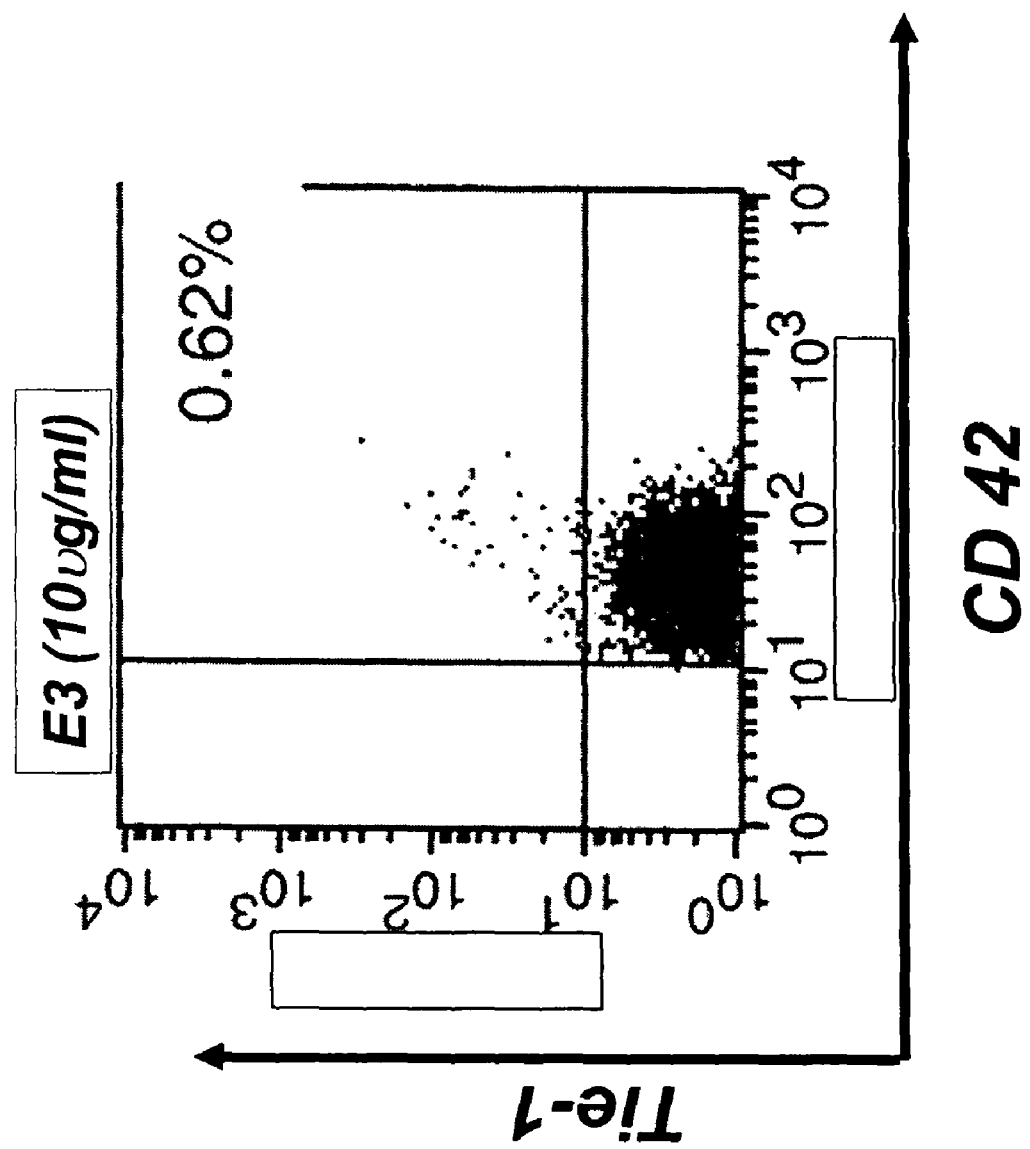
FIG. 1 illustrates a bivariant FACS plot showing labelling with the platelet specific marker CD42 with Tie1 and labelling with the E3 antibody. Only a background number of CD42 positive cells are labelled by the E3 antibody.
Figures 2A, 2B:
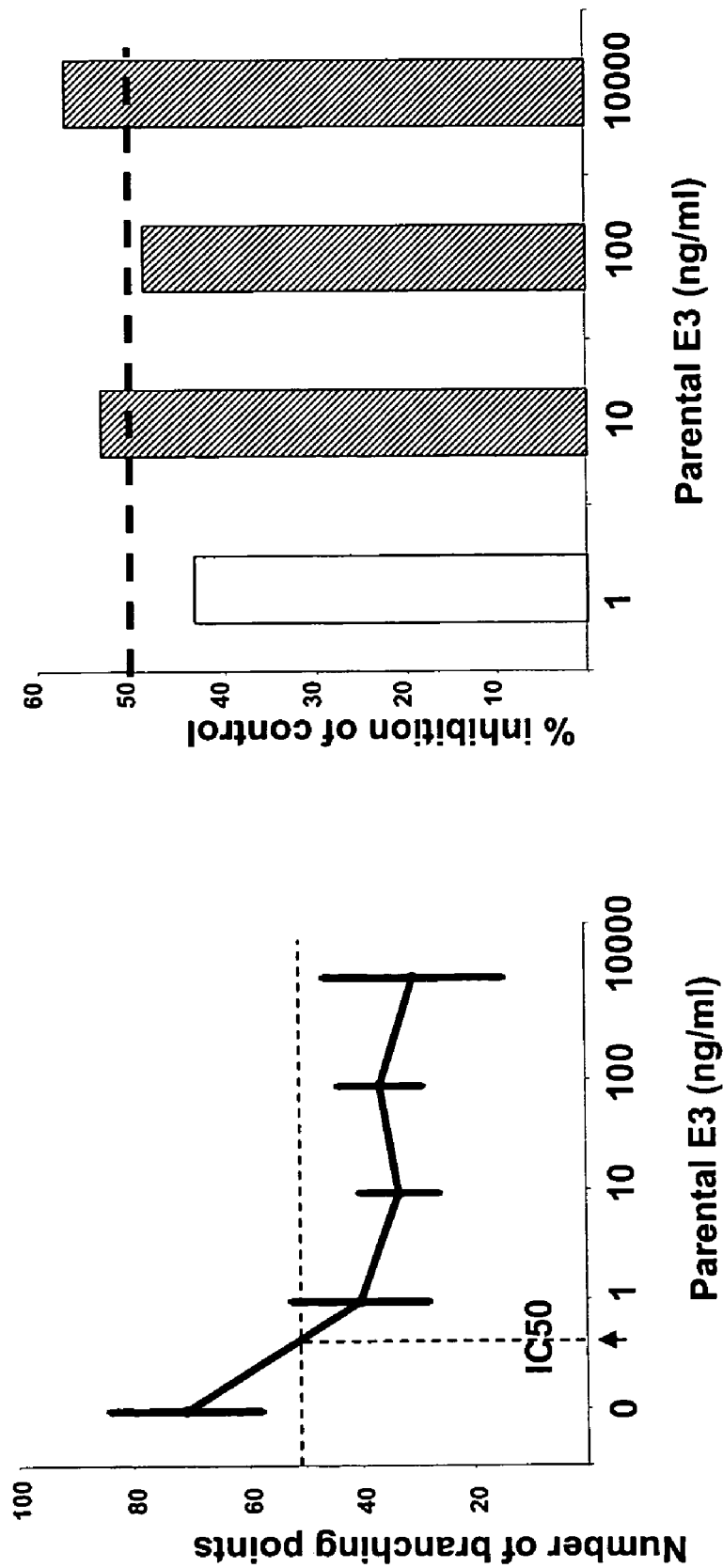
FIGS. 2A, 2B, 2C, and 2D are plots of the number of branching points versus antibody concentration comparing germlined E3 (2C and 2D) with parental E3 (2A and 2B).
Figures 2C, 2D:
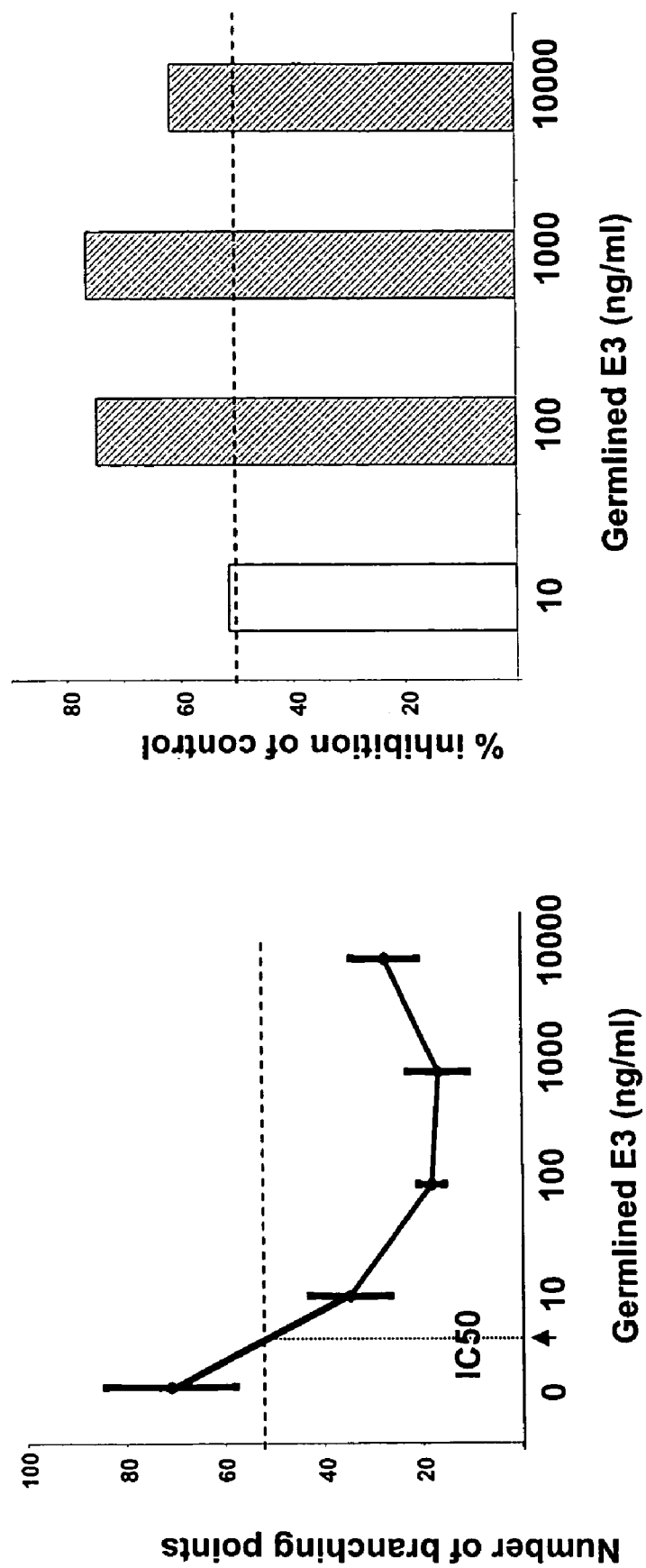
Figure 3:
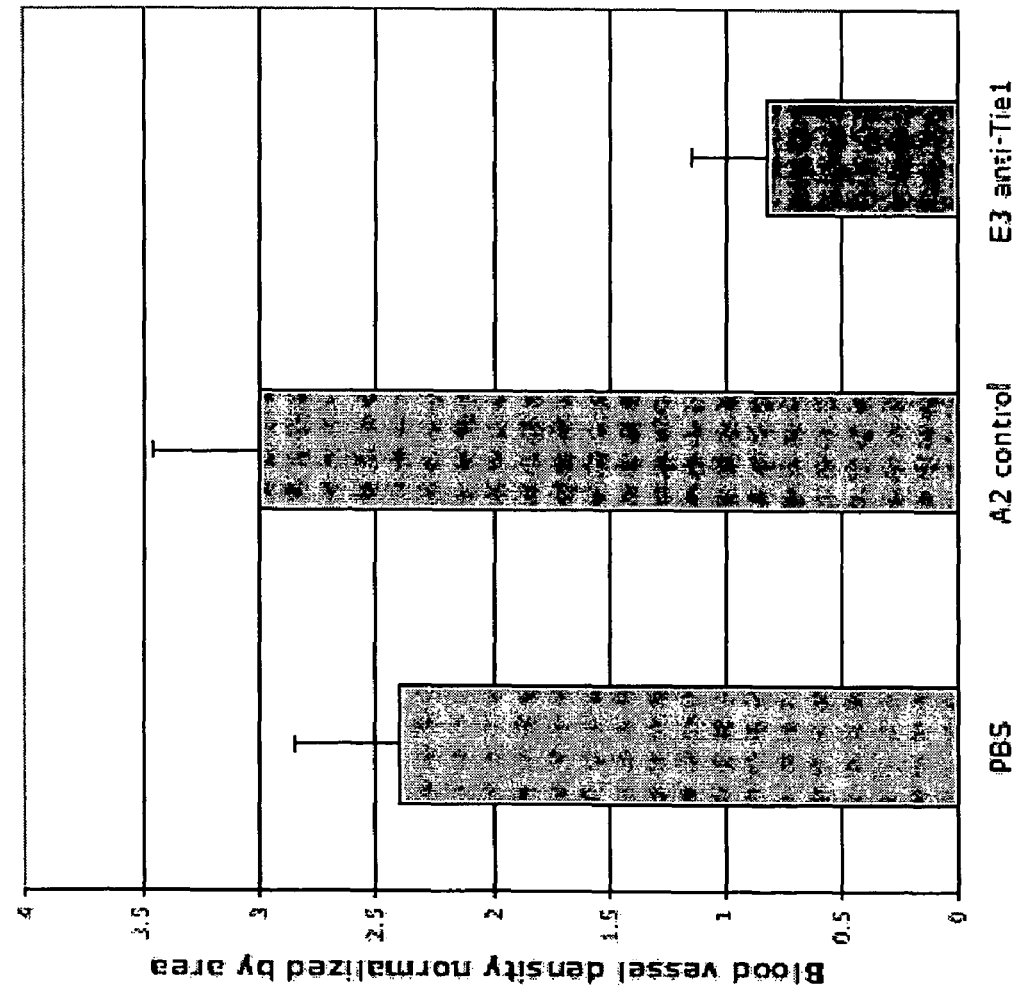
FIG. 3 depicts a graph of blood vessel density in matrigels that were stained with fluorescein-lectin from an in vivo assay using MATRIGEL™ and evaluating the germlined E3 antibody.

This disclosure provides, inter alia, methods for identifying agents (also referred to as "ligands") that bind to components of a Tie complex, e.g., Tie1, Tie2, and Ang. Examples of such agents include proteins, for example, a small peptide (e.g., a cyclic or linear peptide, e.g., of between 7 and 25 amino acids), a polypeptide (e.g., a polypeptide of at least 20 amino acids), or a multi-chain protein (e.g., including at least two peptides or polypeptides). An example of a multi-chain protein is an IgG full-length antibody that has separate heavy and light chains. An example of a polypeptide is a single chain antibody.

A variety of methods are available to identify agents that antagonize formation of a heteromeric Tie complex. For example, agent that bind to Tie1, Tie2, or Ang can be tested for their ability to antagonize formation of heteromeric Tie complexes. Antagonism of this complex decreases Tie2 signaling and its downstream effects, such as promoting angiogenesis.

Tie1 is a receptor tyrosine kinase protein that includes a transmembrane domain. Tie1 is present almost exclusively on endothelial cells. Accordingly, a Tie1-binding protein can be used, e.g., to specifically recognize or target an endothelial cell. Some Tie1-binding proteins can also be used to agonize or antagonize endothelial cells. In some embodiments, these Tie1-binding proteins have an affinity for particular structural features (e.g., a feature listed below), a combination of features listed below, and/or an epitope that includes at least one amino acid in a structural feature listed below:

teins have an affinity for particular structural features, a combination of features, and/or an epitope that includes at least one amino acid in a structural feature. Exemplary structural features include: the N-terminal region of about 50 amino acids, the coiled-coil domain, or the fibrinogen-like domain.

Examples of Ang-binding proteins include proteins that inhibit Ang multimerization (e.g., ability of Ang proteins to form tetramers), proteins that inhibit Ang-Tie2 interactions, and proteins that inhibit a ternary complex of Tie1-Tie2-Ang. Inhibitory proteins can function by disrupting existing interactions or by preventing interactions from occurring.

Tie1 and Tie2 can associate through their extracellular domains and form a heteromeric complex with an angiopoietin (Ang), such as Ang1, Ang2, Ang3, and Ang4. This heteromeric complex activates the intracellular signaling cascade mediated by Tie2. Thus, antagonizing formation of this heteromeric complex provides a novel approach to inhibiting Tie2 signaling and its downstream effects, such as angiogenesis. Complex formation can be antagonized by proteins that bind to the extracellular domains of Tie1 or Tie2 or that bind to Ang so as to prevent its recruitment into the complex or to prevent its multimerization.

| Key | From | To | Length | Description |
|---|---|---|---|---|
| SIGNAL | 1 | 24 | 24 | POTENTIAL. |
| CHAIN | 25 | 1138 | 1114 | TYROSINE-PROTEIN KINASE RECEPTOR TIE1. |
| DOMAIN | 25 | 759 | 735 | EXTRACELLULAR (POTENTIAL). |
| TRANSMEM | 760 | 784 | 25 | POTENTIAL. |
| DOMAIN | 785 | 1138 | 354 | CYTOPLASMIC (POTENTIAL). |
| DOMAIN | 43 | 105 | 63 | IG-LIKE C2-TYPE 1. |
| DOMAIN | 214 | 256 | 43 | EGF-LIKE 1. |
| DOMAIN | 258 | 303 | 46 | EGF-LIKE 2. |
| DOMAIN | 305 | 345 | 41 | EGF-LIKE 3. |
| DOMAIN | 372 | 426 | 55 | IG-LIKE C2-TYPE 2. |
| DOMAIN | 446 | 540 | 95 | FIBRONECTIN TYPE-III 1. |
| DOMAIN | 543 | 639 | 97 | FIBRONECTIN TYPE-III 2. |
| DOMAIN | 643 | 744 | 102 | FIBRONECTIN TYPE-III 3. |
| DOMAIN | 839 | 1118 | 280 | PROTEIN KINASE. |
| NP_BIND | 845 | 853 | 9 | ATP (BY SIMILARITY). |
| BINDING | 870 | 870 | | ATP (BY SIMILARITY). |
| ACT_SITE | 979 | 979 | | BY SIMILARITY. |
| CARBOHYD | 83 | 83 | | N-LINKED (GLCNAC . . . ) (POTENTIAL). |
| CARBOHYD | 161 | 161 | | N-LINKED (GLCNAC . . . ) (POTENTIAL). |
| CARBOHYD | 503 | 503 | | N-LINKED (GLCNAC . . . ) (POTENTIAL). |
| CARBOHYD | 596 | 596 | | N-LINKED (GLCNAC . . . ) (POTENTIAL). |
| CARBOHYD | 709 | 709 | | N-LINKED (GLCNAC . . . ) (POTENTIAL). |
| MOD_RES | 1007 | 1007 | | PHOSPHORYLATION (AUTO-) (BY SIMILARITY). |

The sequence is relative to the amino acid sequence provided in SEQ ID NO:2 (Example 1, below).

Tie2 is a receptor tyrosine kinase protein that includes a transmembrane domain. Tie2 is present almost exclusively on endothelial cells. Accordingly, a Tie2-binding protein can be used, e.g., to specifically recognize or target an endothelial cell. Some Tie2-binding proteins can also be used to modulate (e.g., agonize or antagonize) an activity of an endothelial cell. In some embodiments, these Tie2-binding proteins have an affinity for particular structural features, a combination of features, and/or an epitope that includes at least one amino acid in a structural feature. Exemplary structural features of Tie2 include: two Ig-like domains, three EGF-like domains, and three fibronectin type III domains.

The angiopoietins are a family of ligands that bind to Tie2. Some Ang-binding proteins (e.g., antibodies or artificial Ang-binding proteins) can be used to agonize or antagonize endothelial cells. In some embodiments, these Ang-binding pro- One method for identifying proteins that bind to Tie1 includes: providing a library and selecting from the library one or more members that encode a protein that binds to the Tie1 antigen or a fragment thereof (e.g., the extracellular domain, an EGF domain, a fibronectin repeat, or an Ig-superfamily domain (e.g., a Ig-like C2-type 2 domain)). The selection can be performed in a number of ways. For example, the library can be a display library.

The Tie1 can be tagged and recombinantly expressed. The Tie1 is purified and attached to a support, e.g., to affinity beads, or paramagnetic beads or other magnetically responsive particles.

The Tie1 can also be expressed on the surface of a cell. Members of the display library that specifically bind to the cell, e.g., only if the Tie1 is activated, can be selected.

Analogous procedures can be performed to identify proteins that bind to Tie2 or a fragment thereof (e.g., the extracellular domain, an EGF domain, a fibronectin repeat, or an Ig-superfamily domain (e.g., a Ig-like C2-type 2 domain)).

Analogous procedures can also be performed to identify proteins that bind to Ang or a fragment thereof (e.g., the N-terminal domain, the coiled-coil domain, or the fibrinogen-like domain).

Proteins identified as being capable of binding a Tie complex member can then be tested for their ability to antagonize heteromeric complex formation, as described in the examples below. Proteins identified as antagonizing formation of the heteromeric complex can be used in pharmaceutical compositions to treat a subject in need of such treatment, for example, a subject with an angiogenesis-dependent cancer or tumor or other angiogenesis-related disorders.

Proteins identified as antagonists of Tie complex formation can also be used in combination with other anti-cancer therapies, such as radiation therapy, chemotherapy or treatments that target and negatively regulate the VEGF signaling pathway. Examples of this latter class include VEGF antagonists (e.g., anti-VEGF antibodies such as bevacizumab) and VEGF receptor antagonists (e.g., anti-VEGF receptor antibodies).

Exemplary Tie1 Modulators

In one embodiment, a Tie1-binding protein can modulate a Tie1 activity. For example, a Tie1-binding protein can function as a Tie1 agonist or antagonist in the Tie1/EpoR chimericBAF cell assay described in Example 2.

Tie1 agonists in this Tie1/EpoR chimericBAF cell assay can stimulate certain activity of an endothelial cell under particular conditions, e.g., the conditions of the Tie1/EpoR chimericBAF cell assay.

Some Tie1 binding proteins increase phosphatidylinosoitol 3-kinase (PI3 kinase) activity in an endothelial cell and/or Akt kinase activity. Kontos et al. suggest that the cytoplasmic domain of Tie1 can associate with the p85 subunit of PI3 kinase and activate PI3 kinase activity. Kontos et al. (2002) *Mol. Cell Biol.* 22:1704-1713. The Tie1 cytoplasmic domain may also associate with a protein tyrosine phosphatase Shp2. See, e.g., Marron et al. (2000) *Adv. Exp. Med. Biol.* 476:35-46.

Some Tie binding proteins may increase dimerization, and/or tyrosine phosphorylation (e.g., as a result of auto-phosphorylation) of the Tie1 cytoplasmic domain, e.g., the tyrosine in the motif YVN at about amino acid 1117.

Tie1-binding protein can be evaluated in a cell assay (e.g., in the Tie1/EpoR chimeric BaF cell assay as described below in Example 2). An exemplary cell assay uses a growth factor dependent cell in which a chimeric receptor that includes the Tie1 ectodomain fused to the intracellular domain of the growth factor receptor is expressed. Cells are evaluated for ability to grow in the absence of the essential growth factor, but in the presence of a test compound, e.g., a Tie1-binding protein. If the Tie1-binding protein agonizes Tie1 in the Tie1/EpoR chimeric BaF cell assay, a signalling activity of the Tie1 chimera can substitute for stimulation by the required growth factor thorough its cognate receptor. Thus, survival of the cell in the absence of the required growth factor can be used as an indication that the Tie1-binding protein interacts with the Tie1 ectodomain.

Tie1 agonists in the Tie1/EpoR chimericBAF cell assay may behave as inhibitors of Tie1 activity under other conditions, e.g., in vivo, and, irrespective of in vitro properties, may be useful as inhibitors of angiogenesis in vivo.

Tie1 binding proteins can be used, e.g., to reduce an activity of an endothelial cell. For example, some Tie1 binding proteins can be used to decrease phosphatidylinosoitol 3-kinase (PI3 kinase) activity in an endothelial cell, Shp2 activity, and/or Akt kinase activity. Some Tie1 binding proteins may also reduce dimerization, and/or tyrosine phosphorylation (e.g., as a result of auto-phosphorylation) of the Tie1 cytoplasmic domain, e.g., the tyrosine in the motif YVN at about amino acid 1117.

Tie1-binding protein can be evaluated for activity in a cell assay. For example, the binding protein can be assayed for ability to prevent another ligand, e.g., the E3 antibody, from modulating a Tie1 activity in a cell assay described herein. (e.g., the Tie1/EpoR chimeric BAF cell assay as described below in Example 2).

Display Libraries

A number of methods can be used to identify proteins that bind to Tie1, Tie2, Ang, fragments thereof, complexes that include one or more of these proteins or fragments thereof. In one embodiment, a display library is used to identify such proteins. A display library is a collection of entities; each entity includes an accessible protein component and a recoverable component that encodes or identifies the protein component. The protein component can be of any length, e.g. from three amino acids to over 300 amino acids. In a selection, the protein component of each member of the library is probed with a target, e.g., Tie1 protein, and if the protein component binds to the target, the display library member is identified, e.g., by retention on a support. The method can be adapted for other targets, such as Tie2, Ang, fragments thereof, complexes that include one or more of these proteins or fragments thereof.

Retained display library members are recovered from the support and analyzed. The analysis can include amplification and a subsequent selection under similar or dissimilar conditions. For example, positive and negative selections can be alternated. The analysis can also include determining the amino acid sequence of the protein component and purification of the protein component for detailed characterization.

A variety of formats can be used for display libraries. Examples include the following.

Phage Display. One format utilizes viruses, particularly bacteriophages. This format is termed "phage display." The protein component is typically covalently linked to a bacteriophage coat protein. The linkage results form translation of a nucleic acid encoding the protein component fused to the coat protein. The linkage can include a flexible peptide linker, a protease site, or an amino acid incorporated as a result of suppression of a stop codon. Phage display is described, for example, in Ladner et al., U.S. Pat. No. 5,223,409; Smith (1985) *Science* 228:1315-1317; WO 92/18619; WO 91/17271; WO 92/20791; WO 92/15679; WO 93/01288; WO 92/01047; WO 92/09690; WO 90/02809; de Haard et al. (1999) *J. Biol. Chem* 274:18218-30; Hoogenboom et al. (1998) *Immunotechnology* 4:1-20; Hoogenboom et al. (2000) *Immunol Today* 2:371-8; Fuchs et al. (1991) *Bio/Technology* 9:1370-1372; Hay et al. (1992) *Hum Antibod Hybridomas* 3:81-85; Huse et al. (1989) *Science* 246:1275-1281; Griffiths et al. (1993) *EMBO J.* 12:725-734; Hawkins et al. (1992) *J Mol Biol* 226:889-896; Clackson et al. (1991) *Nature* 352: 624-628; Gram et al. (1992) *PNAS* 89:3576-3580; Garrard et al. (1991) *Bio/Technology* 9:1373-1377; Rebar et al. (1996) *Methods Enzymol.* 267:129-49; Hoogenboom et al. (1991) *Nuc Acid Res* 19:4133-4137; and Barbas et al. (1991) *PNAS* 88:7978-7982.

Phage display systems have been developed for filamentous phage (phage fl, fd, and M13) as well as other bacteriophage (e.g. T7 bacteriophage and lambdoid phages; see, e.g., Santini (1998) *J. Mol. Biol.* 282:125-135; Rosenberg et al. (1996) *Innovations* 6:1-6; Houshm et al. (1999) *Anal Bio-* chem 268:363-370). The filamentous phage display systems typically use fusions to a minor coat protein, such as gene III protein, and gene VIII protein, a major coat protein, but fusions to other coat proteins such as gene VI protein, gene VII protein, gene IX protein, or domains thereof can also been used (see, e.g., WO 00/71694). In one embodiment, the fusion is to a domain of the gene III protein, e.g., the anchor domain or "stump," (see, e.g., U.S. Pat. No. 5,658,727 for a description of the gene III protein anchor domain). It is also possible to physically associate the protein being displayed to the coat using a non-peptide linkage, e.g., a non-covalent bond or a non-peptide covalent bond. For example, a disulfide bond and/or c-fos and c-jun coiled-coils can be used for physical associations (see, e.g., Crameri et al. (1993) *Gene* 137:69 and WO 01/05950).

The valency of the protein component can also be controlled. Cloning of the sequence encoding the protein component into the complete phage genome results in multivariant display since all replicates of the gene III protein are fused to the protein component. For reduced valency, a phagemid system can be utilized. In this system, the nucleic acid encoding the protein component fused to gene III is provided on a plasmid, typically of length less than 7000 nucleotides. The plasmid includes a phage origin of replication so that the plasmid is incorporated into bacteriophage particles when bacterial cells bearing the plasmid are infected with helper phage, e.g., M13K01. The helper phage provides an intact copy of gene III and other phage genes required for phage replication and assembly. The helper phage has a defective origin such that the helper phage genome is not efficiently incorporated into phage particles relative to the plasmid that has a wild type origin.

Bacteriophage displaying the protein component can be grown and harvested using standard phage preparatory methods, e.g., PEG precipitation from growth media.

After selection of individual display phages, the nucleic acid encoding the selected protein components, by infecting cells using the selected phages. Individual colonies or plaques can be picked, the nucleic acid isolated and sequenced.

Cell-based Display. In still another format the library is a cell-display library. Proteins are displayed on the surface of a cell, e.g., a eukaryotic or prokaryotic cell. Exemplary prokaryotic cells include *E. coli* cells, *B. subtilis* cells, and spores (see, e.g., Lu et al. (1995) *Biotechnology* 13:366). Exemplary eukaryotic cells include yeast (e.g., *Saccharomyces cerevisiae, Schizosaccharomyces pombe, Hanseula,* or *Pichia pastoris*). Yeast surface display is described, e.g., in Boder and Wittrup (1997) *Nat. Biotechnol.* 15:553-557 and WO 03/029456, which describes a yeast display system that can be used to display immunoglobulin proteins such as Fab fragments and the use of mating to generate combinations of heavy and light chains.

In one embodiment, variegate nucleic acid sequences are cloned into a vector for yeast display. The cloning joins the variegated sequence with a domain (or complete) yeast cell surface protein, e.g., Aga2, Aga1, Flo1, or Gas1. A domain of these proteins can anchor the polypeptide encoded by the variegated nucleic acid sequence by a transmembrane domain (e.g., Flo1) or by covalent linkage to the phospholipid bilayer (e.g., Gas1). The vector can be configured to express two polypeptide chains on the cell surface such that one of the chains is linked to the yeast cell surface protein. For example, the two chains can be immunoglobulin chains.

In one embodiment, nucleic acids encoding immunoglobulin heavy chains that have been mutagenized based on an initial target-binding immunoglobulin are introduced into yeast cells of one cell type, and nucleic acids encoding immunoglobulin light chains that have been mutagenized based on an initial target-binding immunoglobulin are introduced into yeast cells of the other cell type. These two populations of cells can be combined to form diploid yeast that each express an immunoglobulin heavy and light chain. The yeast cells can be selected and/or screened for cells that bind to the target, e.g., bind with improved affinity.

Ribosome Display. RNA and the polypeptide encoded by the RNA can be physically associated by stabilizing ribosomes that are translating the RNA and have the nascent polypeptide still attached. Typically, high divalent $Mg^{2+}$ concentrations and low temperature are used. See, e.g., Mattheakis et al. (1994) *Proc. Natl. Acad. Sci. USA* 91:9022 and Hanes et al. (2000) *Nat Biotechnol.* 18:1287-92; Hanes et al. (2000) *Methods Enzymol.* 328:404-30; and Schaffitzel et al. (1999) *J Immunol Methods.* 231(1-2):119-35.

Polypeptide-Nucleic Acid Fusions. Another format utilizes polypeptide-nucleic acid fusions. Polypeptide-nucleic acid fusions can be generated by the in vitro translation of mRNA that include a covalently attached puromycin group, e.g., as described in Roberts and Szostak (1997) *Proc. Natl. Acad. Sci. USA* 94:12297-12302, and U.S. Pat. No. 6,207,446. The mRNA can then be reverse transcribed into DNA and crosslinked to the polypeptide.

Other Display Formats. Yet another display format is a non-biological display in which the protein component is attached to a non-nucleic acid tag that identifies the polypeptide. For example, the tag can be a chemical tag attached to a bead that displays the polypeptide or a radiofrequency tag (see, e.g., U.S. Pat. No. 5,874,214).

Display technology can also be used to obtain binding proteins, e.g., antibodies that interact with particular epitopes of a target. This can be done, for example, by using competing non-target molecules that lack the particular epitope or are mutated within the epitope, e.g., with alanine. Such non-target molecules can be used in a negative selection procedure as described below, as competing molecules when binding a display library to the target, or as a pre-elution agent, e.g., to capture in a wash solution dissociating display library members that are not specific to the target.

Iterative Selection. In one preferred embodiment, display library technology is used in an iterative mode. A first display library is used to identify one or more binding proteins for a target. These proteins are then varied, e.g., using a mutagenesis method, to form a second display library. Higher affinity binding proteins are then selected from the second library, e.g., by using higher stringency or more competitive binding and washing conditions.

In some implementations, the mutagenesis is targeted to regions known or likely to be at the binding interface. If, for example, the identified binding proteins are antibodies, then mutagenesis can be directed to the CDR regions of the heavy or light chains as described herein. Further, mutagenesis can be directed to framework regions near or adjacent to the CDRs, e.g., framework regions, particular within ten, five, or three amino acids of a CDR junction. In the case of antibodies, mutagenesis can also be limited to one or a few of the CDRs, e.g., to make precise step-wise improvements.

Some exemplary mutagenesis techniques include: error-prone PCR (Leung et al. (1989) *Technique* 1:11-15), recombination (see, e.g., U.S. Ser. No. 10/279,633), DNA shuffling using random cleavage (Stemmer (1994) *Nature* 389-391; termed "nucleic acid shuffling"), RACHITT™ (Coco et al. (2001) *Nature Biotech.* 19:354), site-directed mutagenesis (Zoller et al. (1987) *Nucl Acids Res* 10:6487-6504), cassette mutagenesis (Reidhaar-Olson (1991) *Methods Enzymol.* 208:

564-586) and incorporation of degenerate oligonucleotides (Griffiths et al. (1994) *EMBO J.* 13:3245).

In one example of iterative selection, the methods described herein are used to first identify a binding protein from a display library that binds a Tie1 with at least a minimal binding specificity for a target or a minimal activity, e.g., an equilibrium dissociation constant for binding of greater than 1 nM, 10 nM, or 100 nM. The nucleic acid sequence encoding the initial identified binding protein is used as a template nucleic acid for the introduction of variations, e.g., to identify a second binding protein that has enhanced properties (e.g., binding affinity, kinetics, or stability) relative to the initial binding protein.

Off-Rate Selection. Since a slow dissociation rate can be predictive of high affinity, particularly with respect to interactions between polypeptides and their targets, the methods described herein can be used to isolate binding proteins with a desired kinetic dissociation rate (i.e. reduced) for a binding interaction to a target.

To select for slow dissociating binding proteins from a display library, the library is contacted to an immobilized target. The immobilized target is then washed with a first solution that removes non-specifically or weakly bound biomolecules. Then the immobilized target is eluted with a second solution that includes a saturation amount of free target, i.e., replicates of the target that are not attached to the particle. The free target binds to biomolecules that dissociate from the target. Rebinding is effectively prevented by the saturating amount of free target relative to the much lower concentration of immobilized target.

The second solution can have solution conditions that are substantially physiological or that are stringent. Typically, the solution conditions of the second solution are identical to the solution conditions of the first solution. Fractions of the second solution are collected in temporal order to distinguish early from late fractions. Later fractions include biomolecules that dissociate at a slower rate from the target than biomolecules in the early fractions.

Further, it is also possible to recover display library members that remain bound to the target even after extended incubation. These can either be dissociated using chaotropic conditions or can be amplified while attached to the target. For example, phage bound to the target can be contacted to bacterial cells.

Selecting and Screening for Specificity. "Selection" refers to a process in which many members of a display library are allowed to contact the target and those that bind are recovered and propagated. The selection can be from a library having numerous members, e.g., more than $10^{10}$ members. "Screening" refers to a process in which isolated members of the library are tested singly for binding to the target. Through automation, thousands of candidates may be screened in a highly parallel process. The display library selection methods described herein can include a selection process that discards display library members that bind to a non-target molecule. Examples of non-target molecules include, e.g., extracellular domains of molecules that include an immunoglobulin super-family domain or an EGF domain and receptor tyrosine kinases other than Tie1, e.g., Tie2, or other than Tie2, e.g., Tie1, or other than Tie1 and Tie2. In one implementation, a so-called "negative selection" step is used to discriminate between the target and related non-target molecule and a related, but distinct non-target molecules. The display library or a pool thereof is contacted to the non-target molecule. Members of the sample that do not bind the non-target are collected and used in subsequent selections for binding to the target molecule or even for subsequent negative selections.

The negative selection step can be prior to or after selecting library members that bind to the target molecule.

In another implementation, a screening step is used. After display library members are isolated for binding to the target molecule, each isolated library member is tested for its ability to bind to a non-target molecule (e.g., a non-target listed above). For example, a high-throughput ELISA screen can be used to obtain this data. The ELISA screen can also be used to obtain quantitative data for binding of each library member to the target. The non-target and target binding data are compared (e.g., using a computer and software) to identify library members that specifically bind to Tie1, Tie2, Ang, fragments thereof, or a complex comprising one or more such components.

The display library selection and screening methods described herein can include a selection or screening process that selects for display library members that bind to specific sites on the target molecule. For example, elution with high concentration of an antibody described herein can be used to select for phage that bind to an epitope that is near or overlaps with the epitope bound by the antibody used for elution. Accordingly, one can screen for a phage that binds to the E3-binding site of Tie1 by performing ELISAs with and without E3 antibody in the buffer.

Selection and Screening for Tie1-Binding Antibodies:

The following description provides one exemplary method for identifying antibodies that bind to Tie1 using a phagemid Fab library. For example, three rounds of selection can be performed with decreasing amounts of target protein (e.g., 100, 50 and 50 μg for first, second, and third rounds, respectively). The target is immobilized on streptavidin coated magnetic beads (Dynal). The library is depleted against streptavidin coated magnetic beads prior to each round of selection and optionally against an unrelated protein which may include a common purification handle. For example, if the target is produced as a fusion to a Fc domain, the library can be depleted against soluble Trail-Fc (a commercially available Fc fusion protein). The depletion process removes Fc binders.

Each round of selection can include, e.g., two cycles of streptavidin magnetic bead depletion, a cycle of binding of phage to Tie1-coated beads, ten cycles of washes, elution of bound phage, and propagation of enriched phage for the next round. Phage bound to Tie1-coated beads after ten washes can be directly amplified or eluted before amplification. After three rounds of selection, individual clones may be grown in 96-well microtiter plates and individually screened for Tie1 binding activity by phage ELISA. ELISAs can include evaluations of binding to Tie1, specificity controls, and unrelated controls. Isolates can be DNA fingerprinted to determine the diversity emerging from the selection process. For example, positive isolates can be PCR amplified with the oligonucleotide primers M13-reverse and geneIII-forward (see, e.g., Marks et al. (1991), *J. Mol. Biol.* 222:581). The products can be analyzed by BstNI fingerprinting.

An exemplary method for performing ELISA's with phage that display a binding protein is as follows. Individual clones can be grown and rescued as described previously (Marks et al. (1991), *J. Mol. Biol.* 222:581). For ELISAs, 96-well Immulon 2 HB plates (Thermo Labsystems) are coated with 1 μg/well ImmunoPure™ streptavidin (Pierce) in PBS and incubated overnight at 4° C. After three washes with PBS, 100 μL of biotinylated Tie1 protein is allowed to bind to the immobilized streptavidin for 30-60 minutes at room temperature. Then, Tie1-coated wells are blocked with 300 μL of 2% milk/1×PBS/0.05% Tween (2% MPBST) for two hours at 37°

C. The wells are incubated with 100 μL of phage culture supernatant that had been blocked with 2% MPBST for one hour at room temperature. The wells are washed five times with 1×PBS/Tween 0.1% (PBST), and incubated with 100 μL of anti-M13-HRP secondary antibody at a 1:5,000 dilution for one hour at room temperature. The wells are washed five times with PBST before developing with TMB-solution and read at 630 nm.

For the cell ELISAs, cells are washed once in PBS and resuspended at a concentration of $1\times10^6$ to $2\times10^6$ cells/mL of PBS. A final concentration of $1-2\times10^5$ cells per well of a 96-well tissue culture plate (Falcon, VWR) can be used. The cells are fixed by adding an equal volume of 0.2% glutaraldehyde (Sigma-Aldrich) and incubating at 37° C. for 12 minutes. They are then washed three times with PBS using an automated plate washer (Bio-Tek Instruments, Inc.) and blocked with 200 μL of 2% MPBST for one hour at room temperature. The rest of the ELISA procedure can be performed as described above except that 1×PBS/Tween 0.05% is used for the washes and incubations.

Germlining Antibodies

It is possible to modify an antibody that binds Tie1, Tie2, or Ang, e.g., an antibody described herein, in order to make the variable regions of the antibody more similar to one or more germline sequences. For example, an antibody can include one, two, three or more amino acid substitutions, e.g., in a framework or CDR region, to make it more similar to a reference germline sequence. One exemplary germlining method can include: identifying one or more germline sequences that are similar (e.g., most similar in a particular database) to the sequence of the isolated antibody. Then mutations (at the amino acid level) can be made in the isolated antibody, either incrementally, in combination, or both. For example, a nucleic acid library that includes sequences encoding some or all possible germline mutations is made. The mutated antibodies are then evaluated, e.g., to identify an antibody that has one or more additional germline residues relative to the isolated antibody and that is still useful (e.g., has a functional activity). In one embodiment, as many germline residues are introduced into an isolated antibody as possible.

In one embodiment, mutagenesis is used to substitute or insert one or more germline residues into a CDR region. For example, the germline CDR residue can be from a germline sequence that is similar (e.g., most similar) to the variable region being modified. After mutagenesis, activity (e.g., binding or other functional activity) of the antibody can be evaluated to determine if the germline residue or residues are tolerated. Similar mutagenesis can be performed in the framework regions.

Selecting a germline sequence can be performed in different ways. For example, a germline sequence can be selected if it meets a predetermined criteria for selectivity or similarity, e.g., at least a certain percentage identity, e.g., at least 75, 80, 85, 90, 91, 92, 93, 94, 95, 96, 97, 98, 99, or 99.5% identity. The selection can be performed using at least 2, 3, 5, or 10 germline sequences. In the case of CDR1 and CDR2, identifying a similar germline sequence can include selecting one such sequence. In the case of CDR3, identifying a similar germline sequence can include selecting one such sequence, but may including using two germline sequences that separately contribute to the amino-terminal portion and the carboxy-terminal portion. In other implementations more than one or two germline sequences are used, e.g., to form a consensus sequence.

In one embodiment, with respect to a particular reference variable domain sequence, e.g., a sequence described herein, a related variable domain sequence has at at least 30, 40, 50, 60, 70, 80, 90, 95 or 100% of the CDR amino acid positions that are not identical to residues in the reference CDR sequences, residues that are identical to residues at corresponding positions in a human germline sequence (i.e., an amino acid sequence encoded by a human germline nucleic acid).

In one embodiment, with respect to a particular reference variable domain sequence, e.g., a sequence described herein, a related variable domain sequence has at at least 30, 50, 60, 70, 80, 90 or 100% of the FR regions are identical to FR sequence from a human germline sequence, e.g., a germline sequence related to the reference variable domain sequence.

Accordingly, it is possible to isolate an antibody which has similar activity to a given antibody of interest, but is more similar to one or more germline sequences, particularly one or more human germline sequences. For example, an antibody can be at least 90, 91, 92, 93, 94, 95, 96, 97, 98, 99, 99.5% identical to a germline sequence in a region outside the CDRs (e.g., framework regions). Further an antibody can include at least 1, 2, 3, 4, or 5 germline residues in a CDR region, the germline residue being from a germline sequence of similar (e.g., most similar) to the variable region being modified. Germline sequences of primary interest are human germline sequences. The activity of the antibody (e.g., the binding activity) can be within a factor or 100, 10, 5, 2, 0.5, 0.1, and 0.001 of the original antibody.

Exemplary germline reference sequences for Vkappa include: O12/O2, O18/O8, A20, A30, L14, L1, L15, L5/18a, L5/L19, L8, L23, L9, L24, L11, L12, O11/O1, A17, A1, A18, A2, A19/A3, A23, A27, A11, L2/L16, L6, L20, L25, B3, B2, A26/A10, and A14. See, e.g., Tomlinson et al. (1995) *EMBO J.* 14(18):4628-3.

A germline reference sequence for the HC variable domain can be based on a sequence that has particular canonical structures, e.g., 1-3 structures in the H1 and H2 hypervariable loops. The canonical structures of hypervariable loops of an immunoglobulin variable domain can be inferred from its sequence, as described in Chothia et al. (1992) *J. Mol. Biol.* 227:799-817; Tomlinson et al. (1992) *J. Mol. Biol.* 227:776-798); and Tomlinson et al. (1995) *EMBO J.* 14(18):4628-38. Exemplary sequences with a 1-3 structure include: DP-1, DP-8, DP-12, DP-2, DP-25, DP-15, DP-7, DP-4, DP-31, DP-32, DP-33, DP-35, DP-40, 7-2, hv3005, hv3005f3, DP-46, DP-47, DP-58, DP-49, DP-50, DP-51, DP-53, and DP-54.

Diversity

Display libraries and other libraries include variation at one or more positions in the displayed polypeptide. The variation at a given position can be synthetic or natural. For some libraries, both synthetic and natural diversity are included.

Synthetic Diversity. Libraries can include regions of diverse nucleic acid sequence that originate from artificially synthesized sequences. Typically, these are formed from degenerate oligonucleotide populations that include a distribution of nucleotides at each given position. The inclusion of a given sequence is random with respect to the distribution. One example of a degenerate source of synthetic diversity is an oligonucleotide that includes NNN wherein N is any of the four nucleotides in equal proportion.

Synthetic diversity can also be more constrained, e.g., to limit the number of codons in a nucleic acid sequence at a given trinucleotide to a distribution that is smaller than NNN. For example, such a distribution can be constructed using less than four nucleotides at some positions of the codon. In addition, trinucleotide addition technology can be used to further constrain the distribution.

So-called "trinucleotide addition technology" is described, e.g., in Wells et al. (1985) *Gene* 34:315-323, U.S. Pat. No. 4,760,025 and U.S. Pat. No. 5,869,644. Oligonucleotides are synthesized on a solid phase support, one codon (i.e., trinucleotide) at a time. The support includes many functional groups for synthesis such that many oligonucleotides are synthesized in parallel. The support is first exposed to a solution containing a mixture of the set of codons for the first position. The unit is protected so additional units are not added. The solution containing the first mixture is washed away and the solid support is deprotected so a second mixture containing a set of codons for a second position can be added to the attached first unit. The process is iterated to sequentially assemble multiple codons. Trinucleotide addition technology enables the synthesis of a nucleic acid that at a given position can encode a number of amino acids. The frequency of these amino acids can be regulated by the proportion of codons in the mixture. Further the choice of amino acids at the given position is not restricted to quadrants of the codon table as is the case if mixtures of single nucleotides are added during the synthesis. Synthetic oligonucleotides including randomized or spiked codons can be also be used for producing a library for an affinity maturation selection.

Natural Diversity. Libraries can include regions of diverse nucleic acid sequence that originate (or are synthesized based on) from different naturally-occurring sequences. An example of natural diversity that can be included in a display library is the sequence diversity present in immune cells (see also below). Nucleic acids are prepared from these immune cells and are manipulated into a format for polypeptide display.

Antibody Display Libraries

In one embodiment, the display library presents a diverse pool of proteins, each of which includes an immunoglobulin domain, e.g., an immunoglobulin variable domain. Display libraries are particular useful, for example for identifying human or "humanized" antibodies that recognize human antigens. Such antibodies can be used as therapeutics to treat human disorders such as endothelial-related disorders, e.g., metastatic cancer. Since the constant and framework regions of the antibody are human, these therapeutic antibodies may avoid themselves being recognized and targeted as antigens. The constant regions are also optimized to recruit effector functions of the human immune system. The in vitro display selection process surmounts the inability of a normal human immune system to generate antibodies against self-antigens.

A typical antibody display library displays a polypeptide that includes a VH domain and a VL domain. An "immunoglobulin domain" refers to a domain from the variable or constant domain of immunoglobulin molecules. Immunoglobulin domains typically contain two β-sheets formed of about seven β-strands, and a conserved disulphide bond (see, e.g., A. F. Williams and A. N. Barclay 1988 *Ann. Rev Immunol.* 6:381-405). The canonical structures of hypervariable loops of an immunoglobulin variable can be inferred from its sequence, as described in Chothia et al. (1992) *J. Mol. Biol.* 227:799-817; Tomlinson et al. (1992) *J. Mol. Biol.* 227:776-798); and Tomlinson et al. (1995) EMBO J. 14(18):4628-38. The display library can display the antibody as a Fab fragment (e.g., using two polypeptide chains) or a single chain Fv (e.g., using a single polypeptide chain). Other formats can also be used.

As in the case of the Fab and other formats, the displayed antibody can include a constant region as part of a light or heavy chain. In one embodiment, each chain includes one constant region, e.g., as in the case of a Fab. In other embodiments, additional constant regions are displayed.

Antibody libraries can be constructed by a number of processes (see, e.g., de Haard et al. (1999) *J. Biol. Chem* 274: 18218-30; Hoogenboom et al. (1998) *Immunotechnology* 4:1-20. and Hoogenboom et al. (2000) *Immunol Today* 21:371-8). Further, elements of each process can be combined with those of other processes. The processes can be used such that variation is introduced into a single immunoglobulin domain (e.g., VH or VL) or into multiple immunoglobulin domains (e.g., VH and VL). The variation can be introduced into an immunoglobulin variable domain, e.g., in the region of one or more of CDR1, CDR2, CDR3, FR1, FR2, FR3, and FR4, referring to such regions of either and both of heavy and light chain variable domains. In one embodiment, variation is introduced into all three CDRs of a given variable domain. In another preferred embodiment, the variation is introduced into CDR1 and CDR2, e.g., of a heavy chain variable domain. Any combination is feasible. In one process, antibody libraries are constructed by inserting diverse oligonucleotides that encode CDRs into the corresponding regions of the nucleic acid. The oligonucleotides can be synthesized using monomeric nucleotides or trinucleotides. For example, Knappik et al. (2000) *J. Mol. Biol.* 296:57-86 describe a method for constructing CDR encoding oligonucleotides using trinucleotide synthesis and a template with engineered restriction sites for accepting the oligonucleotides.

In another process, an animal, e.g., a non-human animal, e.g., a rodent, is immunized with the Tie1. The animal is optionally boosted with the antigen to further stimulate the response. Then spleen cells are isolated from the animal, and nucleic acid encoding VH and/or VL domains is amplified and cloned for expression in the display library. The non-human animal can include one or more human immunoglobulin gene sequences. For example, the animal can include a complete human immunoglobulin locus. The animal may also have an inactivated endogenous immunoglobulin locus.

In yet another process, antibody libraries are constructed from nucleic acid amplified from naïve germline immunoglobulin genes (e.g., human genes). The amplified nucleic acid includes nucleic acid encoding the VH and/or VL domain. Sources of immunoglobulin-encoding nucleic acids are described below. Amplification can include PCR, e.g., with primers that anneal to the conserved constant region, or another amplification method.

Nucleic acid encoding immunoglobulin domains or fragments thereof can be obtained from the immune cells of, e.g., a human, a primate, mouse, rabbit, camel, or rodent. In one example, the cells are selected for a particular property. B cells at various stages of maturity can be selected. In another example, the B cells are naïve.

In one embodiment, fluorescent-activated cell sorting (FACS) is used to sort B cells that express surface-bound IgM, IgD, or IgG molecules. Further, B cells expressing different isotypes of IgG can be isolated. In another preferred embodiment, the B or T cell is cultured in vitro. The cells can be stimulated in vitro, e.g., by culturing with feeder cells or by adding mitogens or other modulatory reagents, such as antibodies to CD40, CD40 ligand or CD20, phorbol myristate acetate, bacterial lipopolysaccharide, concanavalin A, phytohemagglutinin or pokeweed mitogen.

In still another embodiment, the cells are isolated from a subject that has an immunological disorder, e.g., systemic lupus erythematosus (SLE), rheumatoid arthritis, vasculitis, Sjogren syndrome, systemic sclerosis, or anti-phospholipid syndrome. The subject can be a human, or an animal, e.g., an animal model for the human disease, or an animal having an analogous disorder. In yet another embodiment, the cells are isolated from a transgenic non-human animal that includes a human immunoglobulin locus.

In one preferred embodiment, the cells have activated a program of somatic hypermutation. Cells can be stimulated to undergo somatic mutagenesis of immunoglobulin genes, for example, by treatment with anti-immunoglobulin, anti-CD40, and anti-CD38 antibodies (see, e.g., Bergthorsdottir et al. (2001) *J. Immunol.* 166:2228). In another embodiment, the cells are naïve.

The nucleic acid encoding an immunoglobulin variable domain can be isolated from a natural repertoire by the following exemplary method. First, RNA is isolated from the immune cell. Full length (i.e., capped) mRNAs are separated (e.g. by dephosphorylating uncapped RNAs with calf intestinal phosphatase). The cap is then removed with tobacco acid pyrophosphatase and reverse transcription is used to produce the cDNAs.

The reverse transcription of the first (antisense) strand can be done in any manner with any suitable primer. See, e.g., de Haard et al. (1999) *J. Biol. Chem* 274:18218-30. The primer binding region can be constant among different immunoglobulins, e.g., in order to reverse transcribe different isotypes of immunoglobulin. The primer binding region can also be specific to a particular isotype of immunoglobulin. Typically, the primer is specific for a region that is 3' to a sequence encoding at least one CDR. In another embodiment, poly-dT primers may be used (and may be preferred for the heavy-chain genes).

A synthetic sequence can be ligated to the 3' end of the reverse transcribed strand. The synthetic sequence can be used as a primer binding site for binding of the forward primer during PCR amplification after reverse transcription. The use of the synthetic sequence can obviate the need to use a pool of different forward primers to fully capture the available diversity.

The variable domain-encoding gene is then amplified, e.g., using one or more rounds. If multiple rounds are used, nested primers can be used for increased fidelity. The amplified nucleic acid is then cloned into a display library vector.

Any method for amplifying nucleic acid sequences may be used for amplification. Methods that maximize and do not bias diversity are preferred. A variety of techniques can be used for nucleic acid amplification. The polymerase chain reaction (PCR; U.S. Pat. Nos. 4,683,195 and 4,683,202, Saiki, et al. (1985) *Science* 230, 1350-1354) utilizes cycles of varying temperature to drive rounds of nucleic acid synthesis. Transcription-based methods utilize RNA synthesis by RNA polymerases to amplify nucleic acid (U.S. Pat. No. 6,066,457; U.S. Pat. No. 6,132,997; U.S. Pat. No. 5,716,785; Sarkar et. al., *Science* (1989) 244: 331-34; Stofler et al., *Science* (1988) 239: 491). NASBA (U.S. Pat. Nos. 5,130,238; 5,409,818; and 5,554,517) utilizes cycles of transcription, reverse-transcription, and RNaseH-based degradation to amplify a DNA sample. Still other amplification methods include rolling circle amplification (RCA; U.S. Pat. Nos. 5,854,033 and 6,143,495) and strand displacement amplification (SDA; U.S. Pat. Nos. 5,455,166 and 5,624,825).

Secondary Screening Methods

After selecting candidate display library members that bind to a target, each candidate display library member can be further analyzed, e.g., to further characterize its binding properties for the target. Similarly candidate binding proteins (e.g., by immunization, etc.) obtained by other methods can also be analyzed. Each candidate binding protein can be subjected to one or more secondary screening assays. The assay can be for a binding property, a catalytic property, a physiological property (e.g., cytotoxicity, renal clearance, immunogenicity), a structural property (e.g., stability, conformation, oligomerization state) or another functional property. The same assay can be used repeatedly, but with varying conditions, e.g., to determine pH, ionic, or thermal sensitivities.

As appropriate, the assays can use the display library member directly, a recombinant polypeptide produced from the nucleic acid encoding a displayed polypeptide, or a synthetic peptide synthesized based on the sequence of a displayed polypeptide. Exemplary assays for binding properties include the following.

ELISA. Proteins encoded by a display library can also be screened for a binding property using an ELISA assay. For example, each protein is contacted to a microtitre plate whose bottom surface has been coated with the target, e.g., a limiting amount of the target. The plate is washed with buffer to remove non-specifically bound polypeptides. Then the amount of the protein bound to the plate is determined by probing the plate with an antibody that can recognize the polypeptide, e.g., a tag or constant portion of the polypeptide. The antibody is linked to an enzyme such as alkaline phosphatase, which produces a colorimetric product when appropriate substrates are provided. The protein can be purified from cells or assayed in a display library format, e.g., as a fusion to a filamentous bacteriophage coat. Alternatively, cells (e.g., live or fixed) that express the target molecule, e.g., Tie1, Tie2, or Ang, can be plated in a microtitre plate and used to test the affinity of the peptides/antibodies present in the display library or obtained by selection from the display library.

In another version of the ELISA assay, each polypeptide of a diversity strand library is used to coat a different well of a microtitre plate. The ELISA then proceeds using a constant target molecule to query each well.

Cell Binding Assays. Binding proteins (e.g., Tie1, Tie2, or Ang binding proteins) can be evaluated for their ability to interact with one or more cell types, e.g., endothelial cells or platelets. Fluorescent activated cell sorting (FACS) is one exemplary method for testing an interaction between a protein and a cell. The binding protein is labeled directly or indirectly with a fluorophore, before or after, binding to the cells, and then cells are counted in a FACS sorter.

For example, the following method can be used to evaluate whether a Tie1 binding protein interacts with platelets or other cell types.

Isolation of Platelets. Human blood can be obtained from informed healthy volunteers. For example, venous blood is collected into one-sixth volume of ACD (2.5 g of sodium citrate, 1.5 g citric acid, and 2.5 g glucose in 100 ml $dH_2O$). The blood is centrifuged at 800×g for 15 min at room temperature and the platelet-rich plasma is removed and incubated for 60 min at 37° C. in the presence of 1 mM acetylsalicylic acid followed by centrifugation at 1000.times.g for 10 min at room temperature. The platelet pellet can be resuspended at a density of $2 \cdot 10^8$ cells/ml with HEPES-buffered Tyrode's solution (137 mM NaCl, 2.7 mM KCl, 1 mM $MgCl_2$, 3 mM $NaH_2PO_4$, 5 mM glucose, 10 mM HEPES pH 7.4, 0.2% bovine serum albumin, and 0.05 U/mL apyrase). See also, e.g., Kornecki et al. (1990) J Biol. Chem. 265:10, 042-10,048 and Naik et al. (1995) Biochem J. 310:155-162).

FACS. For example, for FACS analysis of platelets, cells can be resuspended in 0.1% BSA/PBS ($4 \times 10^5$ cells/sample)

in the presence of PGE1 (1 mg/mL) and incubated with a candidate Tie1 binding protein (e.g., at about 5 µg/mL) or with a control. After a 1-hour incubation at 22° C., the cells are washed with 0.1% BSA/PBS, treated with 50 µL 1/100 diluted FITC-labeled secondary antibody, incubated for 30 minutes on ice, washed, and resuspended in 0.1% BSA/PBS. The samples are analyzed using an Immunocytometry Systems flow cytometer (FAC Sort, Becton Dickinson, San Jose, Calif.). See also, e.g., Malgorzata et al. (2000) *Blood*, Vol. 95 No. 8 (April 15 pp. 2600-2609.

In addition, it is possible to evaluate platelets by Westerns analysis of SDS-page separated proteins from isolated platelets and by immunoprecipitation. Still other methods involve binding cells to surfaces to which the Tie1-binding protein is attached (e.g., coated to).

Other cell types can be prepared for FACS by methods known in the art.

Homogeneous Binding Assays. The binding interaction of candidate polypeptide with a target can be analyzed using a homogenous assay, i.e., after all components of the assay are added, additional fluid manipulations are not required. For example, fluorescence resonance energy transfer (FRET) can be used as a homogenous assay (see, for example, Lakowicz et al., U.S. Pat. No. 5,631,169; Stavrianopoulos, et al., U.S. Pat. No. 4,868,103). A fluorophore label on the first molecule (e.g., the molecule identified in the fraction) is selected such that its emitted fluorescent energy can be absorbed by a fluorescent label on a second molecule (e.g., the target) if the second molecule is in proximity to the first molecule. The fluorescent label on the second molecule fluoresces when it absorbs to the transferred energy. Since the efficiency of energy transfer between the labels is related to the distance separating the molecules, the spatial relationship between the molecules can be assessed. In a situation in which binding occurs between the molecules, the fluorescent emission of the 'acceptor' molecule label in the assay should be maximal. A binding event that is configured for monitoring by FRET can be conveniently measured through standard fluorometric detection means well known in the art (e.g., using a fluorimeter). By titrating the amount of the first or second binding molecule, a binding curve can be generated to estimate the equilibrium binding constant.

Surface Plasmon Resonance (SPR). The binding interaction of a molecule isolated from a display library and a target can be analyzed using SPR. SPR or Biomolecular Interaction Analysis (BIA) detects biospecific interactions in real time, without labeling any of the interactants. Changes in the mass at the binding surface (indicative of a binding event) of the BIA chip result in alterations of the refractive index of light near the surface (the optical phenomenon of surface plasmon resonance (SPR)). The changes in the refractivity generate a detectable signal, which are measured as an indication of real-time reactions between biological molecules. Methods for using SPR are described, for example, in U.S. Pat. No. 5,641,640; Raether (1988) *Surface Plasmons* Springer Verlag; Sjolander and Urbaniczky (1991) *Anal. Chem.* 63:2338-2345; Szabo et al. (1995) *Curr. Opin. Struct. Biol.* 5:699-705 and on-line resources provide by BIAcore International AB (Uppsala, Sweden).

Information from SPR can be used to provide an accurate and quantitative measure of the equilibrium dissociation constant ($K_d$), and kinetic parameters, including $K_{on}$ and $K_{off}$ for the binding of a biomolecule to a target. Such data can be used to compare different biomolecules. For example, proteins encoded by nucleic acid selected from a library of diversity strands can be compared, to identify individuals that have high affinity for the target or that have a slow $K_{off}$. This information can also be used to develop structure-activity relationships (SAR). For example, the kinetic and equilibrium binding parameters of matured versions of a parent protein can be compared to the parameters of the parent protein. Variant amino acids at given positions can be identified that correlate with particular binding parameters, e.g., high affinity and slow $K_{off}$. This information can be combined with structural modeling (e.g., using homology modeling, energy minimization, or structure determination by crystallography or NMR). As a result, an understanding of the physical interaction between the protein and its target can be formulated and used to guide other design processes.

Protein Arrays. Proteins identified from the display library can be immobilized on a solid support, for example, on a bead or an array. For a protein array, each of the polypeptides is immobilized at a unique address on a support. Typically, the address is a two-dimensional address. Protein arrays are described below (see, e.g., Diagnostics). It is also possible to use a protein array to evaluate any plurality of proteins, e.g., for interaction with Tie1, Tie2, or Ang.

Cellular Assays. Candidate proteins can be selected from a library by transforming the library into a host cell; the library could have been previously identified from a display library. For example, the library can include vector nucleic acid sequences that include segments that encode the polypeptides and that direct expression, e.g., such that the proteins are produced within the cell, secreted from the cell, or attached to the cell surface. The cells can be screened or selected for proteins that bind to the Tie1, Tie2, or Ang, e.g., as detected by a change in a cellular phenotype or a cell-mediated activity. For example, in the case of an antibody that binds to Tie1, the activity may be autophosphorylation, activation of PI3 Kinase, activation of AKT, or a change in endothelial cell activity (e.g., proliferation).

In another embodiment, the library of cells is in the form of a cellular array. The cellular array can likewise be screened for any appropriate detectable activity.

In other embodiments, competition binding assays are used to identify proteins that are compete with a reference protein for binding to Tie1. Similarly, epitope mapping can be used to identify proteins that bind to a particular epitope of Tie. Fragments and mutants of Tie1 can be also be used in the binding protein-identification process, e.g., in one or more of characterization, screening, or immunization.

Methods for Obtaining Target-Binding Antibodies

In addition to the use of display libraries, other methods can be used to obtain a target-binding antibody or in combination with the use of display libraries. For example, the Tie1 ectodomain or a region thereof can be used as an antigen in a non-human animal, e.g., a rodent. Similarly, Tie2 or Ang, or a region thereof can be used as an antigen in a non-human animal, e.g., a rodent.

In one embodiment, the non-human animal includes at least a part of a human immunoglobulin gene. For example, it is possible to engineer mouse strains deficient in mouse antibody production with large fragments of the human Ig loci. Using the hybridoma technology, antigen-specific Mabs derived from the genes with the desired specificity may be produced and selected. See, e.g., XenoMouse™, Green et al. Nature Genetics 7:13-21 (1994), U.S. Pat. No. 2,003,0070185, WO 96/34096, published Oct. 31, 1996, and PCT Application No. PCT/US96/05928, filed Apr. 29, 1996.

In another embodiment, a monoclonal antibody is obtained from the non-human animal, and then modified, e.g., humanized or deimmunized. Winter describes a CDR-grafting method that may be used to prepare the humanized antibodies of the present invention (UK Patent Application GB 2188638A, filed on Mar. 26, 1987; Winter U.S. Pat. No. 5,225,539. All of the CDRs of a particular human antibody may be replaced with at least a portion of a non-human CDR or only some of the CDRs may be replaced with non-human CDRs. It is only necessary to replace the number of CDRs required for binding of the humanized antibody to a predetermined antigen.

Humanized antibodies can be generated by replacing sequences of the Fv variable region that are not directly involved in antigen binding with equivalent sequences from human Fv variable regions. General methods for generating humanized antibodies are provided by Morrison, S. L., 1985, *Science* 229:1202-1207, by Oi et al., 1986, *BioTechniques* 4:214, and by Queen et al. U.S. Pat. No. 5,585,089, U.S. Pat. No. 5,693,761 and U.S. Pat. No. 5,693,762. Those methods include isolating, manipulating, and expressing the nucleic acid sequences that encode all or part of immunoglobulin Fv variable regions from at least one of a heavy or light chain. Sources of such nucleic acid are well known to those skilled in the art and, for example, may be obtained from a hybridoma producing an antibody against a predetermined target, as described above. The recombinant DNA encoding the humanized antibody, or fragment thereof, can then be cloned into an appropriate expression vector.

A target-binding antibody may also be modified by specific deletion of human T cell epitopes or "deimmunization" by the methods disclosed in WO 98/52976 and WO 00/34317, the contents of which are specifically incorporated by reference herein. Briefly, the heavy and light chain variable regions of an antibody can be analyzed for peptides that bind to MHC Class II; these peptides represent potential T-cell epitopes (as defined in WO 98/52976 and WO 00/34317). For detection of potential T-cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T-cell epitopes detected can be eliminated by substituting small numbers of amino acid residues in the variable regions, or preferably, by single amino acid substitutions. As far as possible conservative substitutions are made, often but not exclusively, an amino acid common at this position in human germline antibody sequences may be used. Human germline sequences are disclosed in Tomlinson, I. A. et al. (1992) *J. Mol. Biol.* 227:776-798; Cook, G. P. et al. (1995) *Immunol. Today* Vol. 16 (5): 237-242; Chothia, D. et al. (1992) *J. Mol. Bio.* 227:799-817. The V BASE directory provides a comprehensive directory of human immunoglobulin variable region sequences (compiled by Tomlinson, I. A. et al. MRC Centre for Protein Engineering, Cambridge, UK). After the deimmunizing changes are identified, nucleic acids encoding $V_H$ and $V_L$ can be constructed by mutagenesis or other synthetic methods (e.g., de novo synthesis, cassette replacement, and so forth). Mutagenized variable sequence can, optionally, be fused to a human constant region, e.g., human IgG1 or κ constant regions.

In some cases a potential T cell epitope will include residues which are known or predicted to be important for antibody function. For example, potential T cell epitopes are usually biased towards the CDRs. In addition, potential T cell epitopes can occur in framework residues important for antibody structure and binding. Changes to eliminate these potential epitopes will in some cases require more scrutiny, e.g., by making and testing chains with and without the change. Where possible, potential T cell epitopes that overlap the CDRs were eliminated by substitutions outside the CDRs. In some cases, an alteration within a CDR is the only option, and thus variants with and without this substitution should be tested. In other cases, the substitution required to remove a potential T cell epitope is at a residue position within the framework that might be critical for antibody binding. In these cases, variants with and without this substitution should be tested. Thus, in some cases several variant deimmunized heavy and light chain variable regions were designed and various heavy/light chain combinations tested in order to identify the optimal deimmunized antibody. The choice of the final deimmunized antibody can then be made by considering the binding affinity of the different variants in conjunction with the extent of deimmunization, i.e., the number of potential T cell epitopes remaining in the variable region. Deimmunization can be used to modify an antibody that includes a non-human sequence, e.g., a murine antibody or other non-human monoclonal antibody. Deimmunization can be used to modify an antibody isolated from a display library.

Endothelial Cell Assays

A target-binding protein or a candidate binding protein can be characterized using a cellular assay, e.g., to evaluate a change in a cellular phenotype or other activity when the binding protein is contacted to the cell. Typically the cell is expresses a protein that includes at least part of the ectodomain of Tie. In some embodiments, the cell expresses Tie1, e.g., a full-length, mature Tie1 protein, Tie2, and/or is contacted with Ang.

Endothelial cell proliferation. A candidate target-binding protein can be tested for endothelial proliferation inhibiting activity using a biological activity assay such as the bovine capillary endothelial cell proliferation assay, the chick CAM assay, the mouse corneal assay, and evaluating the effect of the binding protein on implanted tumors. The chick CAM assay is described, e.g., by O'Reilly, et al. in "Angiogenic Regulation of Metastatic Growth" Cell, vol. 79 (2), Oct. 21, 1994, pp. 315-328. Briefly, three day old chicken embryos with intact yolks are separated from the egg and placed in a petri dish. After three days of incubation a methylcellulose disc containing the protein to be tested is applied to the CAM of individual embryos. After 48 hours of incubation, the embryos and CAMs are observed to determine whether endothelial growth has been inhibited. The mouse corneal assay involves implanting a growth factor-containing pellet, along with another pellet containing the suspected endothelial growth inhibitor, in the cornea of a mouse and observing the pattern of capillaries that are elaborated in the cornea.

Angiogenesis. Angiogenesis may be assayed, e.g., using various human endothelial cell systems, such as umbilical vein, coronary artery, or dermal cells. Suitable assays include Alamar Blue based assays (available from Biosource International) to measure proliferation; migration assays using fluorescent molecules, such as the use of Becton Dickinson Falcon HTS FluoroBlock cell culture inserts to measure migration of cells through membranes in presence or absence of angiogenesis enhancer or suppressors; and tubule formation assays based on the formation of tubular structures by endothelial cells on MATRIGEL™ (Becton Dickinson).

Cell adhesion. Cell adhesion assays measure adhesion of cells to purified adhesion proteins or adhesion of cells to each other, in presence or absence of candidate target-binding proteins. Cell-protein adhesion assays measure the ability of agents to modulate the adhesion of cells to purified proteins. For example, recombinant proteins are produced, diluted to 2.5 g/mL in PBS, and used to coat the wells of a microtiter plate. The wells used for negative control are not coated. Coated wells are then washed, blocked with 1% BSA, and washed again. Compounds are diluted to 2.times. final test concentration and added to the blocked, coated wells. Cells are then added to the wells, and the unbound cells are washed off. Retained cells are labeled directly on the plate by adding a membrane-permeable fluorescent dye, such as calcein-AM, and the signal is quantified in a fluorescent microplate reader.

Cell-cell adhesion assays can be used to measure the ability of candidate target-binding proteins to modulate binding of cells to each other. These assays can use cells that naturally or recombinantly express an adhesion protein of choice. In an exemplary assay, cells expressing the cell adhesion protein are plated in wells of a multiwell plate together with other cells (either more of the same cell type, or another type of cell to which the cells adhere). The cells that can adhere are labeled with a membrane-permeable fluorescent dye, such as BCECF, and allowed to adhere to the monolayers in the presence of candidate binding proteins. Unbound cells are washed off, and bound cells are detected using a fluorescence plate reader. High-throughput cell adhesion assays have also been described. See, e.g., Falsey J R et al., Bioconjug Chem. May-June 2001; 12(3):346-53.

Tubulogenesis. Tubulogenesis assays can be used to monitor the ability of cultured cells, generally endothelial cells, to form tubular structures on a matrix substrate, which generally simulates the environment of the extracellular matrix. Exemplary substrates include MATRIGEL™ (Becton Dickinson), an extract of basement membrane proteins containing laminin, collagen IV, and heparin sulfate proteoglycan, which is liquid at 4° C. and forms a solid gel at 37° C. Other suitable matrices comprise extracellular components such as collagen, fibronectin, and/or fibrin. Cells are stimulated with a pro-angiogenic stimulant, and their ability to form tubules is detected by imaging. Tubules can generally be detected after an overnight incubation with stimuli, but longer or shorter time frames may also be used. Tube formation assays are well known in the art (e.g., Jones M K et al., 1999, Nature Medicine 5:1418-1423). These assays have traditionally involved stimulation with serum or with the growth factors FGF or VEGF. In one embodiment, the assay is performed with cells cultured in serum free medium. In one embodiment, the assay is performed in the presence of one or more pro-angiogenic agents, e.g., inflammatory angiogenic factors such as TNF-α, or FGF, VEGF, phorbol myristate acetate (PMA), TNF-alpha, ephrin, etc.

Cell Migration. An exemplary assay for endothelial cell migration is the human microvascular endothelial (HMVEC) migration assay. See, e.g., Tolsma et al. (1993) J. Cell Biol 122, 497-511. Migration assays are known in the art (e.g., Paik J H et al., 2001, J Biol Chem 276:11830-11837). In one example, cultured endothelial cells are seeded onto a matrix-coated porous lamina, with pore sizes generally smaller than typical cell size. The lamina is typically a membrane, such as the transwell polycarbonate membrane (Corning Costar Corporation, Cambridge, Mass.), and is generally part of an upper chamber that is in fluid contact with a lower chamber containing pro-angiogenic stimuli. Migration is generally assayed after an overnight incubation with stimuli, but longer or shorter time frames may also be used. Migration is assessed as the number of cells that crossed the lamina, and may be detected by staining cells with hemotoxylin solution (VWR Scientific), or by any other method for determining cell number. In another exemplary set up, cells are fluorescently labeled and migration is detected using fluorescent readings, for instance using the Falcon HTS FLUOROBLOK™ (Becton Dickinson). While some migration is observed in the absence of stimulus, migration is greatly increased in response to pro-angiogenic factors. The assay can be used to test the effect of a target-binding protein on endothelial cell migration.

Sprouting assay. An exemplary sprouting assay is a three-dimensional in vitro angiogenesis assay that uses a cell-number defined spheroid aggregation of endothelial cells ("spheroid"), embedded in a collagen gel-based matrix. The spheroid can serve as a starting point for the sprouting of capillary-like structures by invasion into the extracellular matrix (termed "cell sprouting") and the subsequent formation of complex anastomosing networks (Korff and Augustin, 1999, J Cell Sci 112:3249-58). In an exemplary experimental set-up, spheroids are prepared by pipetting 400 human umbilical vein endothelial cells into individual wells of a nonadhesive 96-well plates to allow overnight spheroidal aggregation (Korff and Augustin: J Cell Biol 143: 1341-52, 1998). Spheroids are harvested and seeded in 900 μl of methocel-collagen solution and pipetted into individual wells of a 24 well plate to allow collagen gel polymerization. Test agents are added after 30 min by pipetting 100 μl of 10-fold concentrated working dilution of the test substances on top of the gel. Plates are incubated at 37° C. for 24 h. Dishes are fixed at the end of the experimental incubation period by addition of paraformaldehyde. Sprouting intensity of endothelial cells can be quantitated by an automated image analysis system to determine the cumulative sprout length per spheroid.

In some embodiments, a target-binding protein has a statistically significant effect on an assay described herein, e.g., a cellular assay desribed herein.

Protein Production

Standard recombinant nucleic acid methods can be used to express a binding protein that binds to Tie1, Tie2, or Ang. See, for example, the techniques described in Sambrook & Russell, *Molecular Cloning: A Laboratory Manual*, 3$^{rd}$ Edition, Cold Spring Harbor Laboratory, N.Y. (2001) and Ausubel et al., Current Protocols in Molecular Biology (Greene Publishing Associates and Wiley Interscience, N.Y. (1989). Generally, a nucleic acid sequence encoding the binding protein is cloned into a nucleic acid expression vector. If the protein includes multiple polypeptide chains, each chain can be cloned into an expression vector, e.g., the same or different vectors, that are expressed in the same or different cells. Methods for producing antibodies are also provided below.

Antibody Production. Some antibodies, e.g., Fabs, can be produced in bacterial cells, e.g., *E. coli* cells. For example, if the Fab is encoded by sequences in a phage display vector that includes a suppressible stop codon between the display entity and a bacteriophage protein (or fragment thereof), the vector nucleic acid can be shuffled into a bacterial cell that cannot suppress a stop codon. In this case, the Fab is not fused to the gene III protein and is secreted into the media.

Antibodies can also be produced in eukaryotic cells. In one embodiment, the antibodies (e.g., scFv's) are expressed in a yeast cell such as *Pichia* (see, e.g., Powers et al. (2001) *J Immunol Methods*. 251:123-35), *Hanseula*, or *Saccharomyces*.

In one embodiment, antibodies are produced in mammalian cells. Preferred mammalian host cells for expressing the clone antibodies or antigen-binding fragments thereof include Chinese Hamster Ovary (CHO cells) (including dhfr− CHO cells, described in Urlaub and Chasin (1980) *Proc. Natl. Acad. Sci. USA* 77:4216-4220, used with a DHFR selectable marker, e.g., as described in Kaufman and Sharp (1982) *Mol. Biol.* 159:601-621), lymphocytic cell lines, e.g., NS0 myeloma cells and SP2 cells, COS cells, and a cell from a transgenic animal, e.g., a transgenic mammal. For example, the cell is a mammary epithelial cell.

In addition to the nucleic acid sequence encoding the immunoglobulin domain, the recombinant expression vectors may carry additional sequences, such as sequences that regulate replication of the vector in host cells (e.g., origins of replication) and selectable marker genes. The selectable marker gene facilitates selection of host cells into which the vector has been introduced (see e.g., U.S. Pat. Nos. 4,399, 216, 4,634,665 and 5,179,017). For example, typically the selectable marker gene confers resistance to drugs, such as G418, hygromycin or methotrexate, on a host cell into which the vector has been introduced. Preferred selectable marker genes include the dihydrofolate reductase (DHFR) gene (for use in dhfr⁻ host cells with methotrexate selection/amplification) and the neo gene (for G418 selection).

In an exemplary system for recombinant expression of an antibody, or antigen-binding portion thereof, of the invention, a recombinant expression vector encoding both the antibody heavy chain and the antibody light chain is introduced into dhfr– CHO cells by calcium phosphate-mediated transfection. Within the recombinant expression vector, the antibody heavy and light chain genes are each operatively linked to enhancer/promoter regulatory elements (e.g., derived from SV40, CMV, adenovirus and the like, such as a CMV enhancer/AdMLP promoter regulatory element or an SV40 enhancer/AdMLP promoter regulatory element) to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the antibody heavy and light chains and intact antibody is recovered from the culture medium. Standard molecular biology techniques are used to prepare the recombinant expression vector, transfect the host cells, select for transformants, culture the host cells and recover the antibody from the culture medium. For example, some antibodies can be isolated by affinity chromatography with a Protein A or Protein G.

For antibodies that include an Fc domain, the antibody production system preferably synthesizes antibodies in which the Fc region is glycosylated. For example, the Fc domain of IgG molecules is glycosylated at asparagine 297 in the CH2 domain. This asparagine is the site for modification with biantennary-type oligosaccharides. It has been demonstrated that this glycosylation is required for effector functions mediated by Fcγ receptors and complement C1q (Burton and Woof (1992) *Adv. Immunol.* 51:1-84; Jefferis et al. (1998) *Immunol. Rev.* 163:59-76). In a preferred embodiment, the Fc domain is produced in a mammalian expression system that appropriately glycosylates the residue corresponding to asparagine 297. The Fc domain can also include other eukaryotic post-translational modifications.

Antibodies can also be produced by a transgenic animal. For example, U.S. Pat. No. 5,849,992 describes a method of expressing an antibody in the mammary gland of a transgenic mammal. A transgene is constructed that includes a milk-specific promoter and nucleic acids encoding the antibody of interest and a signal sequence for secretion. The milk produced by females of such transgenic mammals includes, secreted-therein, the antibody of interest. The antibody can be purified from the milk, or for some applications, used directly.

It is also possible to produce antibodies that bind to Tie1, Tie2, or Ang by immunization, e.g., using an animal, e.g., with natural, human, or partially human immunoglobulin loci. Such an antibody can be of any allotype, e.g., a,z allotype, f allotype, or non-A allotype. Non-human antibodies can also be modified to include substitutions for human immunoglobulin sequences, e.g., consensus human amino acid residues at particular positions, e.g., at one or more of the following positions (preferably at least five, ten, twelve, or all): (in the FR of the variable domain of the light chain) 4L, 35L, 36L, 38L, 43L, 44L, 58L, 46L, 62L, 63L, 64L, 65L, 66L, 67L, 68L, 69L, 70L, 71L, 73L, 85L, 87L, 98L, and/or (in the FR of the variable domain of the heavy chain) 2H, 4H, 24H, 36H, 37H, 39H, 43H, 45H, 49H, 58H, 60H, 67H, 68H, 69H, 70H, 73H, 74H, 75H, 78H, 91H, 92H, 93H, and/or 103H (according to the Kabat numbering). See, e.g., U.S. Pat. No. 6,407,213.

Tie1 production. Methods for producing Tie1 ectodomain protein, Tie1 protein, or Tie1 liposomes are known in the art. See, e.g., WO 93/14124. Methods for producing Tie2 and Ang are similarly known. See e.g., U.S. Pat. Nos. 6,521,424, 6,376,653; WO 96/11269; WO 96/31598.

Biotinylation Methods. A variety of methods are available to biotinylate proteins, e.g., an immunoglobulin protein or a target protein. For example, the protein can be incubated with a 5-fold molar excess of sulfo-NHS-SS-biotin in 50 mM HEPES, pH 8.0, 100 mM NaCl overnight at 4° C. Free biotin is removed by buffer exchange into PBS, 0.01% Tween 20, e.g., using a BIOMAX® device with a 10 kDa molecular weight cut-off membrane or by dialysis. The number of biotin molecules incorporated per mole of protein can be determined using the HABA assay as described by the manufacturer (Pierce).

Pharmaceutical Compositions

In another aspect, the invention provides compositions, e.g., pharmaceutically acceptable compositions, which include an agent that binds to Tie1, Tie2, or Ang, e.g., an antibody molecule, other polypeptide or peptide identified as binding to Tie1, Tie2, or Ang, or described herein, formulated together with a pharmaceutically acceptable carrier. As used herein, "pharmaceutical compositions" encompass labeled binding proteins (e.g., for in vivo imaging) as well as therapeutic compositions.

As used herein, "pharmaceutically acceptable carrier" includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal or epidermal administration (e.g., by injection or infusion). Depending on the route of administration, the binding protein, may be coated in a material to protect the compound from the action of acids and other natural conditions that may inactivate the compound.

A "pharmaceutically acceptable salt" refers to a salt that retains the desired biological activity of the parent compound and does not impart any undesired toxicological effects (see e.g., Berge, S. M., et al. (1977) *J. Pharm. Sci.* 66:1-19). Examples of such salts include acid addition salts and base addition salts. Acid addition salts include those derived from nontoxic inorganic acids, such as hydrochloric, nitric, phosphoric, sulfuric, hydrobromic, hydroiodic, phosphorous and the like, as well as from nontoxic organic acids such as aliphatic mono- and dicarboxylic acids, phenyl-substituted alkanoic acids, hydroxy alkanoic acids, aromatic acids, aliphatic and aromatic sulfonic acids and the like. Base addition salts include those derived from alkaline earth metals, such as sodium, potassium, magnesium, calcium and the like, as well as from nontoxic organic amines, such as N,N'-dibenzylethylenediamine, N-methylglucamine, chloroprocaine, choline, diethanolamine, ethylenediamine, procaine and the like.

The compositions of this invention may be in a variety of forms. These include, for example, liquid, semi-solid and solid dosage forms, such as liquid solutions (e.g., injectable and infusible solutions), dispersions or suspensions, tablets, pills, powders, liposomes and suppositories. The preferred form depends on the intended mode of administration and therapeutic application. Typical preferred compositions are in the form of injectable or infusible solutions, such as compositions similar to those used for administration of humans with antibodies. The preferred mode of administration is parenteral (e.g., intravenous, subcutaneous, intraperitoneal, intramuscular). In a preferred embodiment, the target-binding protein is administered by intravenous infusion or injection. In another preferred embodiment, the target-binding protein is administered by intramuscular or subcutaneous injection.

The phrases "parenteral administration" and "administered parenterally" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

Pharmaceutical compositions typically must be sterile and stable under the conditions of manufacture and storage. A pharmaceutical composition can also be tested to insure it meets regulatory and industry standards for administration. For example, endotoxin levels in the preparation can be tested using the *Limulus amebocyte* lysate assay (e.g., using the kit from Bio Whittaker lot # 7L3790, sensitivity 0.125 EU/mL) according to the USP 24/NF 19 methods. Sterility of pharmaceutical compositions can be determined using thioglycollate medium according to the USP 24/NF 19 methods. For example, the preparation is used to inoculate the thioglycollate medium and incubated at 35° C. for 14 or more days. The medium is inspected periodically to detect growth of a microorganism.

The composition can be formulated as a solution, microemulsion, dispersion, liposome, or other ordered structure suitable to high drug concentration. Sterile injectable solutions can be prepared by incorporating the binding protein in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

The binding proteins described herein can be administered by a variety of methods known in the art, although for many applications, the preferred route/mode of administration is intravenous injection or infusion. For example, for therapeutic applications, the target-binding protein can be administered by intravenous infusion at a rate of less than 30, 20, 10, 5, or 1 mg/min to reach a dose of about 1 to 100 mg/m$^2$ or 7 to 25 mg/m$^2$. The route and/or mode of administration will vary depending upon the desired results. In certain embodiments, the active compound may be prepared with a carrier that will protect the compound against rapid release, such as a controlled release formulation, including implants, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known. See, e.g., *Sustained and Controlled Release Drug Delivery Systems*, J. R. Robinson, ed., Marcel Dekker, Inc., New York, 1978.

In certain embodiments, the binding protein may be orally administered, for example, with an inert diluent or an assimilable edible carrier. The compound (and other ingredients, if desired) may also be enclosed in a hard or soft shell gelatin capsule, compressed into tablets, or incorporated directly into the subject's diet. For oral therapeutic administration, the compounds may be incorporated with excipients and used in the form of ingestible tablets, buccal tablets, troches, capsules, elixirs, suspensions, syrups, wafers, and the like. To administer a compound of the invention by other than parenteral administration, it may be necessary to coat the compound with, or co-administer the compound with, a material to prevent its inactivation.

Pharmaceutical compositions can be administered with medical devices known in the art. For example, in a preferred embodiment, a pharmaceutical composition of the invention can be administered with a needleless hypodermic injection device, such as the devices disclosed in U.S. Pat. Nos. 5,399,163, 5,383,851, 5,312,335, 5,064,413, 4,941,880, 4,790,824, or 4,596,556. Examples of well-known implants and modules useful in the invention include: U.S. Pat. No. 4,487,603, which discloses an implantable micro-infusion pump for dispensing medication at a controlled rate; U.S. Pat. No. 4,486,194, which discloses a therapeutic device for administering medicants through the skin; U.S. Pat. No. 4,447,233, which discloses a medication infusion pump for delivering medication at a precise infusion rate; U.S. Pat. No. 4,447,224, which discloses a variable flow implantable infusion apparatus for continuous drug delivery; U.S. Pat. No. 4,439,196, which discloses an osmotic drug delivery system having multichamber compartments; and U.S. Pat. No. 4,475,196, which discloses an osmotic drug delivery system. Of course, many other such implants, delivery systems, and modules are also known.

In certain embodiments, the compounds of the invention can be formulated to ensure proper distribution in vivo. For example, the blood-brain barrier (BBB) excludes many highly hydrophilic compounds. To ensure that the therapeutic compounds of the invention cross the BBB (if desired), they can be formulated, for example, in liposomes. For methods of manufacturing liposomes, see, e.g., U.S. Pat. Nos. 4,522,811; 5,374,548; and 5,399,331. The liposomes may include one or more moieties which are selectively transported into specific cells or organs, thus enhance targeted drug delivery (see, e.g., V. V. Ranade (1989) *J. Clin. Pharmacol.* 29:685).

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms of the invention are dictated by and directly dependent on (a) the unique characteristics of the active compound and the particular therapeutic effect to be achieved, and (b) the limitations inherent in the art of compounding such an active compound for the treatment of sensitivity in individuals.

An exemplary, non-limiting range for a therapeutically or prophylactically effective amount of an antibody of the invention is 0.1-20 mg/kg, more preferably 1-10 mg/kg. The target-binding antibody can be administered by intravenous infusion at a rate of less than 30, 20, 10, 5, or 1 mg/min to reach a dose of about 1 to 100 mg/m or about 5 to 30 mg/m$^2$. For binding proteins smaller in molecular weight than an antibody, appropriate amounts can be proportionally less. It is to be noted that dosage values may vary with the type and severity of the condition to be alleviated. It is to be further understood that for any particular subject, specific dosage regimens should be adjusted over time according to the individual need and the professional judgment of the person administering or supervising the administration of the compositions, and that dosage ranges set forth herein are exemplary only and are not intended to limit the scope or practice of the claimed composition.

The pharmaceutical compositions of the invention may include a "therapeutically effective amount" or a "prophylactically effective amount" of an target-binding protein described herein. A "therapeutically effective amount" refers to an amount effective, at dosages and for periods of time necessary, to achieve the desired therapeutic result. A therapeutically effective amount of the composition may vary according to factors such as the disease state, age, sex, and weight of the individual, and the ability of the binding protein to elicit a desired response in the individual. A therapeutically effective amount is also one in which any toxic or detrimental effects of the composition are outweighed by the therapeutically beneficial effects. A "therapeutically effective dosage" preferably inhibits a measurable parameter, e.g., inflammation or tumor growth rate by at least about 20%, more preferably by at least about 40%, even more preferably by at least about 60%, and still more preferably by at least about 80% relative to untreated subjects. The ability of a compound to inhibit a measurable parameter, e.g., cancer, can be evaluated in an animal model system predictive of efficacy in human tumors. Alternatively, this property of a composition can be evaluated by examining the ability of the compound to inhibit, such inhibition in vitro by assays known to the skilled practitioner.

A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

Also within the scope of the invention are kits including the binding protein that binds to Tie1, Tie2, or Ang and instructions for use, e.g., treatment, prophylactic, or diagnostic use. In one embodiment, the instructions for diagnostic applications include the use of the target-binding protein (e.g., antibody or antigen-binding fragment thereof, or other polypeptide or peptide) to detect Tie1, Tie2, or Ang, in vitro, e.g., in a sample, e.g., a biopsy or cells from a patient having an inflammatory disorder or a cancer or neoplastic disorder, or in vivo. In another embodiment, the instructions for therapeutic applications include suggested dosages and/or modes of administration in a patient with a cancer or neoplastic disorder. The kit can further contain a least one additional reagent, such as a diagnostic or therapeutic agent, e.g., a diagnostic or therapeutic agent as described herein, and/or one or more additional target-binding proteins, formulated as appropriate, in one or more separate pharmaceutical preparations.

In one embodiment, target binding proteins (such as the Tie1 antibodies described herein) can be produced from gene-based vectors, such as transgenes or via adenoviral delivery.

Stabilization and Retention

In one embodiment, a target-binding agent (e.g., a Tie1-binding protein, polypeptide, antibody, or aptamer described herein) is physically associated with a moiety that improves its stabilization and/or retention in circulation, e.g., in blood, serum, lymph, or other tissues.

For example, a target-binding agent can be associated with a polymer, e.g., a substantially non-antigenic polymers, such as polyalkylene oxides or polyethylene oxides. Suitable polymers will vary substantially by weight. Polymers having molecular number average weights ranging from about 200 to about 35,000 are usually selected for the purposes of the present invention. Molecular weights of from about 1,000 to about 15,000 are preferred and 2,000 to about 12,500 are particularly preferred.

For example, an target-binding agent can be conjugated to a water soluble polymer, e.g., hydrophilic polyvinyl polymers, e.g. polyvinylalcohol and polyvinylpyrrolidone. A non-limiting list of such polymers include polyalkylene oxide homopolymers such as polyethylene glycol (PEG) or polypropylene glycols, polyoxyethylenated polyols, copolymers thereof and block copolymers thereof, provided that the water solubility of the block copolymers is maintained. Additional useful polymers include polyoxyalkylenes such as polyoxyethylene, polyoxypropylene, and block copolymers of polyoxyethylene and polyoxypropylene (Pluronics); polymethacrylates; carbomers; branched or unbranched polysaccharides which comprise the saccharide monomers D-mannose, D- and L-galactose, fucose, fructose, D-xylose, L-arabinose, D-glucuronic acid, sialic acid, D-galacturonic acid, D-mannuronic acid (e.g. polymannuronic acid, or alginic acid), D-glucosamine, D-galactosamine, D-glucose and neuraminic acid including homopolysaccharides and heteropolysaccharides such as lactose, amylopectin, starch, hydroxyethyl starch, amylose, dextrane sulfate, dextran, dextrins, glycogen, or the polysaccharide subunit of acid mucopolysaccharides, e.g. hyaluronic acid; polymers of sugar alcohols such as polysorbitol and polymannitol; heparin or heparon.

Other compounds can also be attached to the same polymer, e.g., a cytotoxin, a label, or another targeting agent, e.g., another target-binding agent or an unrelated agent. Mono-activated, alkoxy-terminated polyalkylene oxides (PAO's), e.g., monomethoxy-terminated polyethylene glycols (mPEG's); $C_{1-4}$ alkyl-terminated polymers; and bis-activated polyethylene oxides (glycols) can be used for crosslinking. See, e.g., U.S. Pat. No. 5,951,974.

In its most common form poly(ethylene glycol), PEG, is a linear or branched polyether terminated with hydroxyl groups and having the general structure:

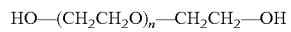

PEG can be synthesized by anionic ring opening polymerization of ethylene oxide initiated by nucleophilic attack of a hydroxide ion on the epoxide ring. Particularly useful for polypeptide modification is monomethoxy PEG, mPEG, having the general structure:

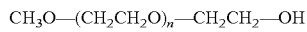

For further description, see, e.g., Roberts et al. (2002) *Advanced Drug Delivery Reviews* 54:459-476.

In one embodiment, the polymer prior to cross-linking need not be, but preferably is, water soluble. Generally, after crosslinking, the product is water soluble, e.g., exhibits a water solubility of at least about 0.01 mg/ml, and more preferably at least about 0.1 mg/ml, and still more preferably at least about 1 mg/ml. In addition, the polymer should not be highly immunogenic in the conjugate form, nor should it possess viscosity that is incompatible with intravenous infusion or injection if the conjugate is intended to be administered by such routes.

In one embodiment, the polymer contains only a single group which is reactive. This helps to avoid cross-linking of protein molecules. However, it is within the scope herein to maximize reaction conditions to reduce cross-linking, or to purify the reaction products through gel filtration or ion exchange chromatography to recover substantially homogenous derivatives. In other embodiments, the polymer contains two or more reactive groups for the purpose of linking multiple agents to the polymer backbone. Again, gel filtration or ion exchange chromatography can be used to recover the desired derivative in substantially homogeneous form.

The molecular weight of the polymer can range up to about 500,000 D, and preferably is at least about 20,000 D, or at least about 30,000 D, or at least about 40,000 D. The molecular weight chosen can depend upon the effective size of the conjugate to be achieved, the nature (e.g. structure, such as linear or branched) of the polymer, and the degree of derivatization.

The covalent crosslink can be used to attach a target-binding agent (e.g., a protein) to a polymer, for example, crosslinking to the N-terminal amino group and epsilon amino groups found on lysine residues, as well as other amino, imino, carboxyl, sulfhydryl, hydroxyl or other hydrophilic groups. The polymer may be covalently bonded directly to the target-binding protein without the use of a multifunctional (ordinarily bifunctional) crosslinking agent. Covalent binding to amino groups is accomplished by known chemistries based upon cyanuric chloride, carbonyl diimidazole, aldehyde reactive groups (PEG alkoxide plus diethyl acetal of bromoacetaldehyde; PEG plus DMSO and acetic anhydride, or PEG chloride plus the phenoxide of 4-hydroxybenzaldehyde, activated succinimidyl esters, activated dithiocarbonate PEG, 2,4,5-trichlorophenylcloroformate or P-nitrophenylcloroformmate activated PEG.) Carboxyl groups can be derivatized by coupling PEG-amine using carbodiimide. Sulfhydryl groups can be derivatized by coupling to maleimido-substituted PEG (e.g. alkoxy-PEG amine plus sulfosuccinimidyl 4-(N-maleimidomethyl)cyclohexane-1-carboxylate) WO 97/10847 or PEG-maleimide commercially available from Shearwater Polymers, Inc., Huntsville, Ala.). Alternatively, free amino groups on the binding protein (e.g. epsilon amino groups on lysine residues) can be thiolated with 2-imino-thiolane (Traut's reagent) and then coupled to maleimide-containing derivatives of PEG, e.g., as described in Pedley et al., Br. J. Cancer, 70: 1126-1130 (1994).

Functionalized PEG polymers that can be attached to a target-binding agent (e.g., protein) are available, e.g., from Shearwater Polymers, Inc. (Huntsville, Ala.). Such commercially available PEG derivatives include, e.g., amino-PEG, PEG amino acid esters, PEG-hydrazide, PEG-thiol, PEG-succinate, carboxymethylated PEG, PEG-propionic acid, PEG amino acids, PEG succinimidyl succinate, PEG succinimidyl propionate, succinimidyl ester of carboxymethylated PEG, succinimidyl carbonate of PEG, succinimidyl esters of amino acid PEGs, PEG-oxycarbonylimidazole, PEG-nitrophenyl carbonate, PEG tresylate, PEG-glycidyl ether, PEG-aldehyde, PEG vinylsulfone, PEG-maleimide, PEG-orthopyridyl-disulfide, heterofunctional PEGs, PEG vinyl derivatives, PEG silanes, and PEG phospholides. The reaction conditions for coupling these PEG derivatives may vary depending on the Tie1-binding protein, the desired degree of PEGylation, and the PEG derivative utilized. Some factors involved in the choice of PEG derivatives include: the desired point of attachment (such as lysine or cysteine R-groups), hydrolytic stability and reactivity of the derivatives, stability, toxicity and antigenicity of the linkage, suitability for analysis, etc. Specific instructions for the use of any particular derivative are available from the manufacturer.

The conjugates of an target-binding agent (e.g., a Tie1 binding protein) and a polymer can be separated from the unreacted starting materials, e.g., by gel filtration or ion exchange chromatography, e.g., HPLC. Heterologous species of the conjugates are purified from one another in the same fashion. Resolution of different species (e.g., containing one or two PEG residues) is also possible, e.g., due to the difference in the ionic properties of unreacted amino acids. See, e.g., WO 96/34015.

A target binding agent can also be physically associated with a protein that provides a stabilizing or retention function, e.g., an albumin, e.g., human serum albumin. U.S. 20040171794 describes exemplary methods for physically associating a protein with serum albumin. For exemplary, human albumin sequences or fragments thereof, see EP 201 239, EP 322 094 WO 97/24445, WO95/23857 especially the mature form of human albumin as shown in SEQ ID NO:18 of U.S. 20040171794 and WO 01/79480 or albumin from other vertebrates or fragments thereof, or analogs or variants of these molecules or fragments thereof. Other exemplary human serum albumin proteins can include one or both of the following sets of point mutations Leu-407 to Ala, Leu408 to Val, Val-409 to Ala, and Arg-410 to Ala; or Arg410 to Ala, Lys-413 to Gln, and Lys-414 to Gln (see, e.g., International Publication No. WO95/23857, with reference to SEQ ID NO:18 of U.S. 20040171794).

Aptamers

In one embodiment, the invention also features target protein-binding agents such as aptamers. The term nucleic acid "aptamer," as used herein, refers to a nucleic acid molecule which has a conformation that includes an internal non-duplex nucleic acid structure of at least 5 nucleotides. An aptamer can be a single-stranded nucleic acid molecule which has regions of self-complementarity. Exemplary aptamers include nucleic acid molecules that bind to a target molecule other than a nucleic acid, e.g., to Tie1, Tie2, or Ang. Particular aptamers may also modulate formation of a Tie complex or have one or more properties of a target binding agent described herein.

Aptamers can be screened in vitro since a selected aptamer can be recovered by standard nucleic acid amplification procedures. The method can be enhanced, e.g., in later rounds of selection, by splitting selected aptamers into pools and modifying each aptamer in the pool with a detectable label such as a fluorophore. Pools having aptamers that functionally alter the properties of the label can be identified. Such pools can be repeatedly split and reanalyzed to identify the individual aptamers with the desired properties (see, e.g., Jhaveri et al. *Nature Biotechnol.* 18:1293).

In addition, aptamers can be screened for activity in vivo. For example, shuffled nucleic acids can be cloned into an expression vector that is introduced into cells. RNA aptamers resulting from the expressed shuffled nucleic acids can be screened for a biological activity. Cells having the activity can be isolated and the expression vector for the selected RNA aptamer recovered.

An important feature of therapeutic oligomers (e.g., aptamers) is the design of the backbone of the administered oligomer. In some embodiments, the backbone contains internucleoside linkages that are stable in vivo and is structured such that the oligomer is resistant to endogenous nucleases, such as nucleases that attack the phosphodiester linkage. At the same time, the oligomer retains its ability to hybridize to the target DNA or RNA (Agarwal, K. L. et al. (1979) *Nucleic Acids Res.* 6:3009; Agarwal, S. et al. (1988) *Proc. Natl. Acad. Sci USA* 85:7079). Modified oligonucleotides can be constructed using alternate internucleoside linkages. Several of these exemplary linkages are described in Uhlmann, E. and Peyman, A. (1990) *Chemical Reviews* 90:543-584. Among these are methylphosphonates (wherein one of the phosphorus-linked oxygens has been replaced by methyl); phosphorothioates (wherein sulphur replaces one of these oxygens) and various amidates (wherein $NH_2$ or an organic amine derivative, such as morpholidates or piperazidates, replace an oxygen). These substitutions confer enhanced stability. WO 91/15500 teaches various oligonucleotide analogs in which one or more of the internucleotide linkages are replaced by a sulfur based linkage, typically sulfamate diesters, which are isosteric and isoelectric with the phosphodiester. WO 89/12060 similarly discloses linkages containing sulfides, sulfoxides, and sulfones. WO 86/05518 suggests a variant of stereoregular polymeric 3',5'linkages. U.S. Pat. No. 5,079,151 discloses a msDNA molecule of branched RNA linked to a single strand DNA via a 2',5' phosphodiester linkage. U.S. Pat. No. 5,264,562 describes modified linkages of the formula —Y'CX'$_2$Y'— wherein Y' is independently O or S and wherein each X' is a stabilizing substituent and independently chosen. Morpholino-type internucleotide linkages are described in U.S. Pat. No. 5,034,506 and in some cases give rise to an increased affinity of the oligomer for complementary target sequences. U.S. Pat. Nos. 5,264,562 5,596,086 disclose modified oligonucleotides having modified nucleoside linkages which are capable of strong hybridization to target RNA and DNA.

Treatments

Binding proteins that bind to Tie1, Tie2, or Ang have therapeutic and prophylactic utilities. For example, these binding proteins can be administered to cells in culture, e.g. in vitro or ex vivo, or in a subject, e.g., in vivo, to treat, prevent, and/or diagnose a variety of disorders, such as endothelial cell disorders, blood vessel development disorders, wound healing, inflammatory diseases and cancers, particularly metastatic cancers.

As used herein, the term "treat" or "treatment" is the application or administration of an gent, alone or in combination with one or more other agents (e.g., a second agent) to a subject, e.g., a patient, or application or administration of the agent to an isolated tissue or cell, e.g., cell line, from a subject, e.g., a patient, who has a disorder (e.g., a disorder as described herein), a symptom of a disorder or a predisposition toward a disorder, with the purpose to cure, heal, alleviate, relieve, alter, remedy, ameliorate, improve or affect the disorder, the symptoms of the disorder or the predisposition toward the disorder.

In one embodiment, "treating a cell" refers to a reduction in the activity and/or proliferation of a cell, e.g., a hyperproliferative cell. Such reduction does not necessarily indicate a total elimination of the cell, but a reduction, e.g., a statistically significant reduction, in the activity or the number of the cell. An example of a reduction in activity is a reduction in migration of the cell or a reduction in cell differentiation.

As used herein, an amount of an target-binding protein effective to treat a disorder, or a "therapeutically effective amount" refers to an amount of the binding protein which is effective, upon single or multiple dose administration to a subject, in treating a cell, e.g., an endothelial cell (e.g., a Tie1-expressing endothelial cell) or cancer cell (particularly a metastatic cell thereof), or in prolonging curing, alleviating, relieving or improving a subject with a disorder as described herein beyond that expected in the absence of such treatment. As used herein, "inhibiting the growth" of the neoplasm refers to slowing, interrupting, arresting or stopping its growth and metastases and does not necessarily indicate a total elimination of the neoplastic growth.

As used herein, an amount of an target-binding protein effective to prevent a disorder, or a "a prophylactically effective amount" of the binding protein refers to an amount of an Tie1-binding protein, e.g., an Tie1-binding antibody described herein, which is effective, upon single- or multiple-dose administration to the subject, in preventing or delaying the occurrence of the onset or recurrence of a disorder, e.g., an endothelial cell-related disorder, a blood vessel development disorder, an inflammatory disease or a cancer.

The terms "induce", "inhibit", "potentiate", "elevate", "increase", "decrease" or the like, e.g., which denote quantitative differences between two states, refer to a difference, e.g., a statistically significant difference, between the two states. For example, "an amount effective to inhibit the proliferation of the Tie1-expressing hyperproliferative cells" means that the rate of growth of the cells will be different, e.g., statistically significantly different, from the untreated cells.

As used herein, the term "subject" is intended to include human and non-human animals. Preferred human animals include a human patient having a disorder characterized by abnormal cell proliferation or cell differentiation. The term "non-human animals" of the invention includes all vertebrates, e.g., non-mammals (such as chickens, amphibians, reptiles) and mammals, such as non-human primates, sheep, dog, cow, pig, etc.

In one embodiment, the subject is a human subject. Alternatively, the subject can be a mammal expressing a Tie1-like antigen with which an antibody of the invention cross-reacts. A binding protein described herein can be administered to a human subject for therapeutic purposes (discussed further below) or to a non-human animal, e.g., for veterinary purposes or as an animal model of human disease. Regarding the latter, such animal models may be useful for evaluating the therapeutic efficacy of the binding protein (e.g., testing of dosages and time courses of administration).

In one embodiment, the invention provides a method of treating (e.g., inhibiting, ablating or killing) a cell (e.g., a non-cancerous cell, e.g., a normal, benign or hyperplastic cell, or a cancerous cell, e.g., a malignant cell, e.g., cell found in a solid tumor, a soft tissue tumor, or a metastatic lesion (e.g., a cell found in renal, urothelial, colonic, rectal, pulmonary, breast or hepatic, cancers and/or metastasis)). Methods of the invention include the steps of contacting the cell with an Tie1-binding protein, e.g., an Tie1-binding antibody described herein, in an amount sufficient to treat, e.g., inhibit, ablate or kill, the cell.

The subject method can be used on cells in culture, e.g. in vitro or ex vivo. For example, cancerous or metastatic cells (e.g., renal, urothelial, colon, rectal, lung, breast, ovarian, prostatic, or liver cancerous or metastatic cells) can be cultured in vitro in culture medium, e.g., with endothelial cells, and the contacting step can be effected by adding the Tie1-binding protein to the culture medium. The method can be performed on cells (e.g., cancerous or metastatic cells) present in a subject, as part of an in vivo (e.g., therapeutic or prophylactic) protocol. For in vivo embodiments, the contacting step is effected in a subject and includes administering the Tie1-binding protein to the subject under conditions effective to permit both binding of the binding protein to the cell and the treating, e.g., the killing or ablating of the cell.

The method can be used to treat a cancer. As used herein, the terms "cancer", "hyperproliferative", "malignant", and "neoplastic" are used interchangeably, and refer to those cells an abnormal state or condition characterized by rapid proliferation or neoplasm. The terms include all types of cancerous growths or oncogenic processes, metastatic tissues or malignantly transformed cells, tissues, or organs, irrespective of histopathologic type or stage of invasiveness. "Pathologic hyperproliferative" cells occur in disease states characterized by malignant tumor growth.

The common medical meaning of the term "neoplasia" refers to "new cell growth" that results as a loss of responsiveness to normal growth controls, e.g. to neoplastic cell growth. A "hyperplasia" refers to cells undergoing an abnormally high rate of growth. However, as used herein, the terms neoplasia and hyperplasia can be used interchangeably, as their context will reveal, referring generally to cells experiencing abnormal cell growth rates. Neoplasias and hyperplasias include "tumors," which may be benign, premalignant or malignant. In one embodiment, reduction in Tie1 activity by a Tie1-binding protein can reduce or prevent angiogenesis near and around the tumor, thereby reducing or preventing tumor growth. In another embodiment, the neoplasia includes endothelial cells that are proliferating abnormally. A Tie1-binding protein can be used to modulate the cells of the neoplasia themselves.

Examples of cancerous disorders include, but are not limited to, solid tumors, soft tissue tumors, and metastatic lesions. Examples of solid tumors include malignancies, e.g., sarcomas, adenocarcinomas, and carcinomas, of the various organ systems, such as those affecting lung, breast, lymphoid, gastrointestinal (e.g., colon), and genitourinary tract (e.g., renal, urothelial cells), pharynx, prostate, ovary as well as adenocarcinomas which include malignancies such as most colon cancers, rectal cancer, renal-cell carcinoma, liver cancer, non-small cell carcinoma of the lung, cancer of the small intestine and so forth. Metastatic lesions of the aforementioned cancers can also be treated or prevented using the methods and compositions of the invention.

The subject method can be useful in treating malignancies of the various organ systems, such as those affecting lung, breast, lymphoid, gastrointestinal (e.g., colon), and genitourinary tract, prostate, ovary, pharynx, as well as adenocarcinomas which include malignancies such as most colon cancers, renal-cell carcinoma, prostate cancer and/or testicular tumors, non-small cell carcinoma of the lung, cancer of the small intestine and cancer of the esophagus. Exemplary solid tumors that can be treated include: fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, testicular tumor, lung carcinoma, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, and retinoblastoma.

The term "carcinoma" is recognized by those skilled in the art and refers to malignancies of epithelial or endocrine tissues including respiratory system carcinomas, gastrointestinal system carcinomas, genitourinary system carcinomas, testicular carcinomas, breast carcinomas, prostatic carcinomas, endocrine system carcinomas, and melanomas. Exemplary carcinomas include those forming from tissue of the cervix, lung, prostate, breast, head and neck, colon and ovary. The term also includes carcinosarcomas, e.g., which include malignant tumors composed of carcinomatous and sarcomatous tissues. An "adenocarcinoma" refers to a carcinoma derived from glandular tissue or in which the tumor cells form recognizable glandular structures.

The term "sarcoma" is recognized by those skilled in the art and refers to malignant tumors of mesenchymal derivation.

The subject method can also be used to inhibit the proliferation of hyperplastic/neoplastic cells of hematopoietic origin, e.g., cells arising from myeloid, lymphoid or erythroid lineages, or precursor cells thereof. For instance, the binding proteins described herein can be used for the treatment of various myeloid disorders including, but not limited to, acute promyeloid leukemia (APML), acute myelogenous leukemia (AML) and chronic myelogenous leukemia (CML) (reviewed in Vaickus, L. (1991) *Crit Rev. in Oncol./Hemotol.* 11:267-97). Lymphoid malignancies which may be treated include, but are not limited to acute lymphoblastic leukemia (ALL), which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas contemplated by the treatment method of the invention include, but are not limited to, non-Hodgkin's lymphoma and variants thereof, peripheral T-cell lymphomas, adult T-cell leukemia/lymphoma (ATL), cutaneous T-cell lymphoma (CTCL), large granular lymphocytic leukemia (LGF) and Hodgkin's disease. As Tie1 has been shown to be upregulated in acute myelogenous leukaemia and myelodysplastic syndrome (Verstovsek et al., 2001, Leuk, Lymphoma), B cell chronic lymphocytic leukaemia (Aguayo et al, 2001. Leukemia Research), ligands that interact with Tie1 can be used to detect, treat, or prevent these diseases.

Methods of administering Tie1-binding proteins are described in "Pharmaceutical Compositions". Suitable dosages of the molecules used will depend on the age and weight of the subject and the particular drug used. The ligands can be used as competitive agents to inhibit, reduce an undesirable interaction, e.g., between a natural or pathological agent and the Tie1.

The ligands described herein can be used in combination with other therapies to treat subjects in need of such treatment, e.g., subjects suffering from angiogenesis-related disorders, such as cancer, and disorders that include undesired endothelial cell proliferation or undesirable inflammation, e.g., rheumatoid arthritis. The other therapies can include e.g., another protein, peptide, or compound that disrupts complex formation or that acts as an antagonist of Tie signaling; treatment with another anti-cancer agent, as described below; and treatments that inhibit the VEGF signaling pathway. For example, subjects can be treated with VEGF antagonists, e.g., anti-VEGF antibodies such as bevacizumab; or VEGF receptor antagonists, e.g., anti-VEGF receptor antibodies or small molecule inhibitors, compounds having a molecular weight of less than 1500 daltons.

Exemplary inhibitors and VEGF receptor antagonists include inhibitors of VEGF receptor tyrosine kinase activity. 4-[4-(1-Amino-1-methylethyl)phenyl]-2-[4-(2-morpholin-4-yl-ethyl)phenylamino]pyrimidine-5-carbonitrile (JNJ-17029259) is one of a structural class of 5-cyanopyrimidines that are orally available, selective, nanomolar inhibitors of the vascular endothelial growth factor receptor-2 (VEGF-R2). Additional examples include: PTK-787/ZK222584 (Astra-Zeneca), SU5416, SU11248 (Pfizer), and ZD6474 ([N-(4-bromo-2-fluorophenyl)-6-methoxy-7-[(1-methylpiperidin-4-yl)methoxy]quinazolin-4-amine]). Still other agents that can be used in combination with Tie1-binding proteins are broad specificity tyrosine kinase inhibitors, e.g., SU6668. See, e.g., Bergers, B. et al. (2003) J. Clin. Invest. 111, 1287-1295.

In one embodiment, the Tie1-binding proteins are used to inhibit (e.g., inhibit at least one activity of, reduce proliferation, migration, growth or viability) of a cell, e.g., an endothelial cell in vivo. The ligands can be used by themselves or conjugated to an agent, e.g., a cytotoxic drug, radioisotope. This method includes: administering the ligand alone or attached to a cytotoxic drug, to a subject requiring such treatment.

The terms "cytotoxic agent" and "cytostatic agent" and "anti-tumor agent" are used interchangeably herein and refer to agents that have the property of inhibiting the growth or proliferation (e.g., a cytostatic agent), or inducing the killing, of hyperproliferative cells, e.g., an aberrant cancer cell. In cancer therapeutic embodiment, the term "cytotoxic agent" is used interchangeably with the terms "anti-cancer" or "anti-tumor" to mean an agent, which inhibits the development or progression of a neoplasm, particularly a solid tumor, a soft tissue tumor, or a metastatic lesion.

Nonlimiting examples of anti-cancer agents include, e.g., anti-microtubule agents, topoisomerase inhibitors, antimetabolites, mitotic inhibitors, alkylating agents, intercalating agents, agents capable of interfering with a signal transduction pathway, agents that promote apoptosis, radiation, and antibodies against other tumor-associated antigens (including naked antibodies, immunotoxins and radioconjugates). Examples of the particular classes of anti-cancer agents are provided in detail as follows: antitubulin/antimicrotubule, e.g., paclitaxel, vincristine, vinblastine, vindesine, vinorelbin, taxotere; topoisomerase I inhibitors, e.g., irinotecan, topotecan, camptothecin, doxorubicin, etoposide, mitoxantrone, daunorubicin, idarubicin, teniposide, amsacrine, epirubicin, merbarone, piroxantrone hydrochloride; antimetabolites, e.g., 5-fluorouracil (5-FU), methotrexate, 6-mercaptopurine, 6-thioguanine, fludarabine phosphate, cytarabine/Ara-C, trimetrexate, gemcitabine, acivicin, alanosine, pyrazofurin, N-Phosphoracetyl-L-Asparate=PALA, pentostatin, 5-azacitidine, 5-Aza 2'-deoxycytidine, ara-A, cladribine, 5-fluorouridine, FUDR, tiazofurin, N-[5-[N-(3,4-dihydro-2-methyl-4-oxoquinazolin-6-ylmethyl)-N-methylamino]-2-thenoyl]-L-glutamic acid; alkylating agents, e.g., cisplatin, carboplatin, mitomycin C, BCNU=Carmustine, melphalan, thiotepa, busulfan, chlorambucil, plicamycin, dacarbazine, ifosfamide phosphate, cyclophosphamide, nitrogen mustard, uracil mustard, pipobroman, 4-ipomeanol; agents acting via other mechanisms of action, e.g., dihydrolenperone, spiromustine, and desipeptide; biological response modifiers, e.g., to enhance anti-tumor responses, such as interferon; apoptotic agents, such as actinomycin D; and anti-hormones, for example anti-estrogens such as tamoxifen or, for example antiandrogens such as 4'-cyano-3-(4-fluorophenylsulphonyl)-2-hydroxy-2-methyl-3'-(trifluoromethyl) propionanilide.

The Tie-1 binding proteins can also be administered with a second therapy that includes an agent that reduces the side effects of other therapies. The agent can be an agent that reduces the side effects of anti-cancer treatments. For example, the agent can be leucovorin.

Since the Tie1-binding proteins recognize Tie1-expressing endothelial cells and can bind to endothelial cells that are associated with (e.g., in proximity of or intermingled with) cancer cells, e.g., cancerous lung, liver, colon, breast, ovarian, epidermal, laryngeal, and cartilage cells, and particularly metastatic cells thereof, Tie1-binding proteins can be used to inhibit (e.g., inhibit at least one activity, reduce growth and proliferation, or kill) any such cells to which the ligands bind. Reducing endothelial cell activity near a cancer can indirectly inhibit (e.g., inhibit at least one activity, reduce growth and proliferation, or kill) the cancer cells which may be dependent on the endothelial cells for nutrients, growth signals and so forth.

Alternatively, the ligands bind to cells in the vicinity of the cancerous cells, but are sufficiently close to the cancerous cells to directly or indirectly inhibit (e.g., inhibit at least one activity, reduce growth and proliferation, or kill) the cancers cells. Thus, the Tie1-binding proteins (e.g., modified with a toxin, e.g., a cytotoxin) can be used to selectively inhibit (e.g., kill or ablate cells in cancerous tissue (including the cancerous cells themselves and endothelial cells associated with or invading the cancer).

The ligands may be used to deliver a variety of cytotoxic drugs including therapeutic drugs, a compound emitting radiation, molecules of plants, fungal, or bacterial origin, biological proteins, and mixtures thereof. The cytotoxic drugs can be intracellularly acting cytotoxic drugs, such as short-range radiation emitters, including, for example, short-range, high-energy α-emitters, as described herein.

Enzymatically active toxins and fragments thereof are exemplified by diphtheria toxin A fragment, non-binding active fragments of diphtheria toxin, exotoxin A (from *Pseudomonas aeruginosa*), ricin A chain, abrin A chain, modeccin A chain, α-sacrin, certain *Aleurites fordii* proteins, certain Dianthin proteins, *Phytolacca americana* proteins (PAP, PAPII and PAP-S), Morodica charantia inhibitor, curcin, crotin, *Saponaria officinalis* inhibitor, gelonin, mitogillin, restrictocin, phenomycin, and enomycin. Procedures for preparing enzymatically active polypeptides of the immunotoxins are described in WO84/03508 and WO85/03508, and in the appended Examples below. Examples of cytotoxic moieties that can be conjugated to the antibodies include adriamycin, chlorambucil, daunomycin, methotrexate, neocarzinostatin, and platinum.

In the case of polypeptide toxins, recombinant nucleic acid techniques can be used to construct a nucleic acid that encodes the ligand (or a protein component thereof) and the cytotoxin (or a protein component thereof) as translational fusions. The recombinant nucleic acid is then expressed, e.g., in cells and the encoded fusion polypeptide isolated.

Procedures for conjugating binding proteins (e.g., antibodies) with the cytotoxic agents have been previously described. Procedures for conjugating chlorambucil with antibodies are described by Flechner (1973) *European Journal of Cancer*, 9:741-745; Ghose et al. (1972) *British Medical Journal*, 3:495-499; and Szekerke, et al. (1972) *Neoplasma*, 19:211-215. Procedures for conjugating daunomycin and adriamycin to antibodies are described by Hurwitz, E. et al. (1975) *Cancer Research*, 35:1175-1181 and Amon et al. (1982) *Cancer Surveys*, 1:429-449. Procedures for preparing antibody-ricin conjugates are described in U.S. Pat. No. 4,414,148 and by Osawa, T., et al. (1982) *Cancer Surveys*, 1:373-388 and the references cited therein. Coupling procedures as also described in EP 86309516.2.

To kill or ablate normal, benign hyperplastic, or cancerous cells, a first binding protein is conjugated with a prodrug which is activated only when in close proximity with a prodrug activator. The prodrug activator is conjugated with a second binding protein, preferably one which binds to a non-competing site on the target molecule. Whether two binding proteins bind to competing or non-competing binding sites can be determined by conventional competitive binding assays. Drug-prodrug pairs suitable for use in the practice of the invention are described in Blakely et al., (1996) *Cancer Research*, 56:3287-3292.

Alternatively, the Tie1-binding protein can be coupled to high energy radiation emitters, for example, a radioisotope, such as $^{131}$I, a γ-emitter, which, when localized at the tumor site, results in a killing of several cell diameters. See, e.g., S. E. Order, "Analysis, Results, and Future Prospective of the Therapeutic Use of Radiolabeled Antibody in Cancer Therapy", *Monoclonal Antibodies for Cancer Detection and Therapy*, R. W. Baldwin et al. (eds.), pp 303-316 (Academic Press 1985). Other suitable radioisotopes include α-emitters, such as $^{212}$Bi, $^{213}$Bi, and $^{211}$At, and β-emitters, such as $^{186}$Re and $^{90}$Y. Moreover, Lu$^{117}$ may also be used as both an imaging and cytotoxic agent.

Radioimmunotherapy (RIT) using antibodies labeled with $^{131}$I, $^{90}$Y, and $^{177}$Lu is under intense clinical investigation. There are significant differences in the physical characteristics of these three nuclides and as a result, the choice of radionuclide is very critical in order to deliver maximum radiation dose to the tumor. The higher beta energy particles of $^{90}$Y may be good for bulky tumors. The relatively low energy beta particles of $^{131}$I are ideal, but in vivo dehalogenation of radiolodinated molecules is a major disadvantage for internalizing antibody. In contrast, $^{177}$Lu has low energy beta particle with only 0.2-0.3 mm range and delivers much lower radiation dose to bone marrow compared to $^{90}$Y. In addition, due to longer physical half-life (compared to $^{90}$Y), the tumor residence times are higher. As a result, higher activities (more mCi amounts) of $^{177}$Lu labeled agents can be administered with comparatively less radiation dose to marrow. There have been several clinical studies investigating the use of $^{177}$Lu labeled antibodies in the treatment of various cancers. (Mulligan T et al. (1995) *Clin Cancer Res*. 1:1447-1454; Meredith R F, et al. (1996) *J Nucl Med* 37:1491-1496; Alvarez R D, et al. (1997) *Gynecologic Oncology* 65: 94-101).

The Tie1-binding proteins can be used directly in vivo to eliminate antigen-expressing cells via natural complement-dependent cytotoxicity (CDC) or antibody-dependent cellular cytotoxicity (ADCC). The binding proteins of the invention, can include complement binding effector domain, such as the Fc portions from IgG1, -2, or -3 or corresponding portions of IgM which bind complement. In one embodiment, a population of target cells is ex vivo treated with a binding agent of the invention and appropriate effector cells. The treatment can be supplemented by the addition of complement or serum containing complement. Further, phagocytosis of target cells coated with a binding protein of the invention can be improved by binding of complement proteins. In another embodiment target, cells coated with the binding protein which includes a complement binding effector domain are lysed by complement.

Also encompassed by the invention is a method of killing or ablating which involves using the anti-Tie1 ligand for prophylaxis. For example, these materials can be used to prevent or delay development or progression of cancers.

Use of the therapeutic methods of the invention to treat cancers has a number of benefits. Since the binding proteins specifically recognize Tie1, other tissue is spared and high levels of the agent are delivered directly to the site where therapy is required. Treatment in accordance with the invention can be effectively monitored with clinical parameters. Alternatively, these parameters can be used to indicate when such treatment should be employed.

Tie1-binding proteins of the invention can be administered in combination with one or more of the existing modalities for treating cancers, including, but not limited to: surgery; radiation therapy, and chemotherapy.

Diagnostic Uses

Binding proteins that bind to Tie1 (e.g., antibodies, e.g., an antibody described herein) have in vitro and in vivo diagnostic, therapeutic and prophylactic utilities.

In one aspect, the invention provides a diagnostic method for detecting the presence of a Tie1, in vitro (e.g., a biological sample, such as tissue, biopsy, e.g., a cancerous tissue) or in vivo (e.g., in vivo imaging in a subject).

The method includes: (i) contacting a sample with Tie1-binding protein; and (ii) detecting formation of a complex between the Tie1-binding protein and the sample. The method can also include contacting a reference sample (e.g., a control sample) with the ligand, and determining the extent of formation of the complex between the ligand and the sample relative to the same for the reference sample. A change, e.g., a statistically significant change, in the formation of the complex in the sample or subject relative to the control sample or subject can be indicative of the presence of Tie1 in the sample.

Another method includes: (i) administering the Tie1-binding protein to a subject; and (iii) detecting formation of a complex between the Tie1-binding protein, and the subject. The detecting can include determining location or time of formation of the complex.

The Tie1-binding protein can be directly or indirectly labeled with a detectable substance to facilitate detection of the bound or unbound antibody. Suitable detectable substances include various enzymes, prosthetic groups, fluorescent materials, luminescent materials and radioactive materials.

Complex formation between the Tie1-binding protein and Tie1 can be detected by measuring or visualizing either the ligand bound to the Tie1 or unbound ligand. Conventional detection assays can be used, e.g., an enzyme-linked immunosorbent assays (ELISA), a radioimmunoassay (RIA) or tissue immunohistochemistry. Further to labeling the Tie1-binding protein, the presence of Tie1 can be assayed in a sample by a competition immunoassay utilizing standards labeled with a detectable substance and an unlabeled Tie1-binding protein. In one example of this assay, the biological sample, the labeled standards and the Tie1 binding agent are combined and the amount of labeled standard bound to the unlabeled ligand is determined. The amount of Tie1 in the sample is inversely proportional to the amount of labeled standard bound to the Tie1 binding agent.

Fluorophore and chromophore labeled binding proteins can be prepared. Since antibodies and other proteins absorb light having wavelengths up to about 310 nm, the fluorescent moieties should be selected to have substantial absorption at wavelengths above 310 nm and preferably above 400 nm. A variety of suitable fluorescers and chromophores are described by Stryer (1968) *Science,* 162:526 and Brand, L. et al. (1972) *Annual Review of Biochemistry,* 41:843-868. The binding proteins can be labeled with fluorescent chromophore groups by conventional procedures such as those disclosed in U.S. Pat. Nos. 3,940,475, 4,289,747, and 4,376, 110. One group of fluorescers having a number of the desirable properties described above is the xanthene dyes, which include the fluoresceins and rhodamines. Another group of fluorescent compounds are the naphthylamines. Once labeled with a fluorophore or chromophore, the binding protein can be used to detect the presence or localization of the Tie1 in a sample, e.g., using fluorescent microscopy (such as confocal or deconvolution microscopy).

Histological Analysis. Immunohistochemistry can be performed using the binding proteins described herein. For example, in the case of an antibody, the antibody can synthesized with a label (such as a purification or epitope tag), or can be detectably labeled, e.g., by conjugating a label or label-binding group. For example, a chelator can be attached to the antibody. The antibody is then contacted to a histological preparation, e.g., a fixed section of tissue that is on a microscope slide. After an incubation for binding, the preparation is washed to remove unbound antibody. The preparation is then analyzed, e.g., using microscopy, to identify if the antibody bound to the preparation. The method can be used to evaluate an endothelial cell or tissue formed by endothelial cells, e.g., blood vessels.

The antibody (or other polypeptide or peptide) can be unlabeled at the time of binding. After binding and washing, the antibody is labeled in order to render it detectable.

Protein Arrays. The Tie1-binding protein can also be immobilized on a protein array. The protein array can be used as a diagnostic tool, e.g., to screen medical samples (such as isolated cells, blood, sera, biopsies, and the like). Of course, the protein array can also include other ligands, e.g., that bind to Tie1 or to other target molecules, such as hyaluronic acid.

Methods of producing polypeptide arrays are described, e.g., in De Wildt et al. (2000) *Nat. Biotechnol.* 18:989-994; Lueking et al. (1999) *Anal. Biochem.* 270:103-111; Ge (2000) *Nucleic Acids Res.* 28, e3, I-VII; MacBeath and Schreiber (2000) *Science* 289:1760-1763; WO 01/40803 and WO 99/51773A1. Polypeptides for the array can be spotted at high speed, e.g., using commercially available robotic apparati, e.g., from Genetic MicroSystems or BioRobotics. The array substrate can be, for example, nitrocellulose, plastic, glass, e.g., surface-modified glass. The array can also include a porous matrix, e.g., acrylamide, agarose, or another polymer.

For example, the array can be an array of antibodies, e.g., as described in De Wildt, supra. Cells that produce the binding proteins can be grown on a filter in an arrayed format. Polypeptide production is induced, and the expressed polypeptides are immobilized to the filter at the location of the cell.

A protein array can be contacted with a labeled target to determine the extent of binding of the target to each immobilized polypeptide from the diversity strand library. If the target is unlabeled, a sandwich method can be used, e.g., using a labeled probed, to detect binding of the unlabeled target.

Information about the extent of binding at each address of the array can be stored as a profile, e.g., in a computer database. The protein array can be produced in replicates and used to compare binding profiles, e.g., of a target and a non-target. Thus, protein arrays can be used to identify individual members of the diversity strand library that have desired binding properties with respect to one or more molecules.

FACS. (Fluorescent Activated Cell Sorting). The target-binding protein can be used to label cells, e.g., cells in a sample (e.g., a patient sample). The binding protein can also be attached (or attachable) to a fluorescent compound. The cells can then be sorted using fluorescent activated cell sorted (e.g., using a sorter available from Becton Dickinson Immunocytometry Systems, San Jose Calif.; see also U.S. Pat. Nos. 5,627,037; 5,030,002; and 5,137,809). As cells pass through the sorter, a laser beam excites the fluorescent compound while a detector counts cells that pass through and determines whether a fluorescent compound is attached to the cell by detecting fluorescence. The amount of label bound to each cell can be quantified and analyzed to characterize the sample.

The sorter can also deflect the cell and separate cells bound by the binding protein from those cells not bound. The separated cells can be cultured and/or characterized.

In vivo Imaging. In still another embodiment, the invention provides a method for detecting the presence of a Tie1-expressing cancerous tissues in vivo. The method includes (i) administering to a subject (e.g., a patient having a cancer or neoplastic disorder) an Tie1-binding antibody, conjugated to a detectable marker; (ii) exposing the subject to a means for detecting said detectable marker to the Tie1-expressing tissues or cells. For example, the method can be used visualize blood vessels or the location of endothelial cells, e.g., Tie1-expressing endothelial cells. The subject can be imaged, e.g., by NMR or other tomographic means.

Examples of labels useful for diagnostic imaging include radiolabels such as $^{131}$I, $^{111}$In, $^{123}$I, $^{99m}$Tc, $^{32}$P, $^{125}$I, $^{3}$H, $^{14}$C, and $^{188}$Rh, fluorescent labels such as fluorescein and rhodamine, nuclear magnetic resonance active labels, positron emitting isotopes detectable by a positron emission tomography ("PET") scanner, chemiluminescers such as luciferin, and enzymatic markers such as peroxidase or phosphatase. Short-range radiation emitters, such as isotopes detectable by short-range detector probes can also be employed. The binding protein can be labeled with such reagents using known techniques. For example, see Wensel and Meares (1983) *Radioimmunoimaging and Radioimmunotherapy,* Elsevier, New York for techniques relating to the radiolabeling of antibodies and D. Colcher et al. (1986) *Meth. Enzymol.* 121: 802-816.

A radiolabeled binding protein can also be used for in vitro diagnostic tests. The specific activity of an isotopically-labeled protein depends upon the half-life, the isotopic purity of the radioactive label, and how the label is incorporated into the protein.

Effective imaging agents for tumor-associated neo-vasculature are needed. Tie1 is up regulated on tumor-associated vasculature. The binding proteins described herein can be used to image such vasculature.

The binding proteins described herein can be used for imaging in several ways. A binding protein can be physically associated, e.g., coupled to a chelator for imaging agents such as $^{99m}$Tc, $^{186}$Re, or $^{88}$Re. $^{99m}$Tc and $^{188}$Re emit gamma rays suitable for single photon emission computer tomography (SPECT) imaging. Radioactive fluorine ($^{18}$F), indium ($^{111}$In), iodine ($^{123}$I, $^{131}$I), gallium ($^{68}$Ga, $^{67}$Ga), carbon ($^{11}$C), thallium ($^{201}$Tl), and other elements may be used as imaging agents.

The binding proteins can also be attached, covalently or non-covalently, to a particle, e.g., a nano-particle, that includes a radionuclide or spin labels suitable for use as an imaging agent. The binding proteins can be linked to a spin label that would allow imaging through MRI. Botnar et al. (*Circulation*. (2004) 109:2023-2029.) describe MRI imaging using an exemplary gadolinium-labeled peptide. The binding proteins described herein can be similarly labeled for imaging.

Chen et al. (*J. Nucl. Med.*, (2004) 45:1776-1783) showed that coupling a small PEG molecule (average molecular weight 3.4 KDa) improved that pharmacodynamics of an $\alpha_v\beta_3$-binding peptide. Binding peptides (e.g., Tie1, Tie2, or Ang binding peptides) can be coupled to PEG molecules to adjust the clearance rate and pathway.

Positron Emission Tomography (PET) can be used with imaging agents such as positron emitters such as $^{64}$Cu and $^{18}$F. These isotopes are becoming more readily available. $^{64}$Cu can be captured in the chelator DOTA. DOTA derivatives can be covalently linked to proteins. In one embodiment, one or more DOTA derivatives are attached to a binding protein (e.g., a Fab) through a lysine side group.

Fabs are useful binding agents for imaging because they: a) clear from the system fairly raipdly, allowing imaging within a few hours of injection, and b) penetrate tumors efficiently.

Fabs that bind to Tie1, Tie2, or Ang can be produced, e.g., in *E. coli* or in eukaryotic cells. The Fabs can be purified by chromatography over protein A. Ion exchange chromatography can also be used. For use in imaging, covalent attachment of a chelating group suitable to the desired radionuclide or other imaging agent allows the Fab to be labeled at the time of use. The Fabs can also have spin labels attached to allow MRI imaging Fabs can also be attached to particles (e.g., nanoparticles) that include a radionuclide or spin label suitable for imaging. In particular embodiments, Fabs may be coupled to PEG molecules to adjust the rate and pathway of clearance. In other embodiments, the Fabs are not coupled to PEG, e.g., to maintain their rapid clearance properties.

Procedures for labeling polypeptides with the radioactive isotopes (such as $^{14}$C, $^{3}$H, $^{35}$S, $^{125}$I, $^{32}$P, $^{131}$I) are generally known. For example, tritium labeling procedures are described in U.S. Pat. No. 4,302,438. Iodinating, tritium labeling, and $^{35}$S labeling procedures, e.g., as adapted for murine monoclonal antibodies, are described, e.g., by Goding, J. W. (*Monoclonal antibodies: principles and practice: production and application of monoclonal antibodies in cell biology, biochemistry, and immunology* 2nd ed. London; Orlando: Academic Press, 1986. pp 124-126) and the references cited therein. Other procedures for iodinating polypeptides, such as antibodies, are described by Hunter and Greenwood (1962) *Nature* 144:945, David et al. (1974) *Biochemistry* 13:1014-1021, and U.S. Pat. Nos. 3,867,517 and 4,376,110. Radiolabeling elements which are useful in imaging include $^{123}$I, $^{131}$I, $^{111}$In, and $^{99m}$Tc, for example. Procedures for iodinating antibodies are described by Greenwood, F. et al. (1963) *Biochem. J.* 89:114-123; Marchalonis, J. (1969) *Biochem. J.* 113:299-305; and Morrison, M. et al. (1971) *Immunochemistry* 289-297. Procedures for $^{99m}$Tc-labeling are described by Rhodes, B. et al. in Burchiel, S. et al. (eds.), *Tumor Imaging: The Radioimmunochemical Detection of Cancer*, New York: Masson 111-123 (1982) and the references cited therein. Procedures suitable for $^{111}$In-labeling antibodies are described by Hnatowich, D. J. et al. (1983) *J. Immul. Methods*, 65:147-157, Hnatowich, D. et al. (1984) *J. Applied Radiation*, 35:554-557, and Buckley, R. G. et al. (1984) *F.E.B.S.* 166:202-204.

In the case of a radiolabeled ligand, the ligand is administered to the patient, is localized to the tumor bearing the antigen with which the ligand reacts, and is detected or "imaged" in vivo using known techniques such as radionuclear scanning using e.g., a gamma camera or emission tomography. See e.g., A. R. Bradwell et al., "Developments in Antibody Imaging", *Monoclonal Antibodies for Cancer Detection and Therapy*, R. W. Baldwin et al., (eds.), pp 65-85 (Academic Press 1985). Alternatively, a positron emission transaxial tomography scanner, such as designated Pet VI located at Brookhaven National Laboratory, can be used where the radiolabel emits positrons (e.g., $^{11}$C, $^{18}$F, $^{15}$O, and $^{13}$N).

MRI Contrast Agents. Magnetic Resonance Imaging (MRI) uses NMR to visualize internal features of living subject, and is useful for prognosis, diagnosis, treatment, and surgery. MRI can be used without radioactive tracer compounds for obvious benefit. Some MRI techniques are summarized in EP-A-0 502 814. Generally, the differences related to relaxation time constants T1 and T2 of water protons in different environments are used to generate an image. However, these differences can be insufficient to provide sharp high resolution images.

The differences in these relaxation time constants can be enhanced by contrast agents. Examples of such contrast agents include a number of magnetic agents paramagnetic agents (which primarily alter T1) and ferromagnetic or superparamagnetic (which primarily alter T2 response). Chelates (e.g., EDTA, DTPA and NTA chelates)+can be used to attach (and reduce toxicity) of some paramagnetic substances (e.g., $Fe^{+3}$, $Mn^{+2}$, $Gd^{+3}$). Other agents can be in the form of particles, e.g., less than 10 μm to about 10 nM in diameter). Particles can have ferromagnetic, antiferromagnetic or superparamagnetic properties. Particles can include, e.g., magnetite ($Fe_3O_4$), $\gamma$-$Fe_2O_3$, ferrites, and other magnetic mineral compounds of transition elements. Magnetic particles may include: one or more magnetic crystals with and without nonmagnetic material. The nonmagnetic material can include synthetic or natural polymers (such as sepharose, dextran, dextrin, starch and the like The target-binding proteins can also be labeled with an indicating group containing of the NMR-active $^{19}$F atom, or a plurality of such atoms inasmuch as (i) substantially all of naturally abundant fluorine atoms are the $^{19}$F isotope and, thus, substantially all fluorine-containing compounds are NMR-active; (ii) many chemically active polyfluorinated compounds such as trifluoracetic anhydride are commercially available at relatively low cost, and (iii) many fluorinated compounds have been found medically acceptable for use in humans such as the perfluorinated polyethers utilized to carry oxygen as hemoglobin replacements. After permitting such time for incubation, a whole body MRI is carried out using an apparatus such as one of those described by Pykett (1982) *Scientific American*, 246:78-88 to locate and image cancerous tissues.

Information obtained from evaluating an target-binding protein, e.g., a ligand described herein, can be recorded on machine-compatible media, e.g., computer readable or computer accessible media. The information can be stored as a computer representation, e.g., in a database (e.g., in the case of imaging using a ligand, a database of images for one or a plurality of subjects). The term "computer representation" refers to information which is in a form that can be manipulated by a computer. The act of storing a computer representation refers to the act of placing the information in a form suitable for manipulation by a computer.

Also within the scope of the invention are kits including the binding protein that binds to Tie1 and instructions for diagnostic use, e.g., the use of the target-binding protein (e.g., antibody or antigen-binding fragment thereof, or other polypeptide or peptide) to detect Tie1, in vitro, e.g., in a sample, e.g., a biopsy or cells from a patient having a cancer or neoplastic disorder, or in vivo, e.g., by imaging a subject. The kit can further contain a least one additional reagent, such as a label or additional diagnostic agent. For in vivo use the ligand can be formulated as a pharmaceutical composition.

The following invention is further illustrated by the following examples (commencing on the following page), which should not be construed as limiting.

EXAMPLES

Example 1

Tie1 Sequences

An exemplary Tie1 amino acid sequence is as follows:

```
                                              (SEQ ID NO: 2)
MVWRVPPFLLPILFLASHVGAAVDLTLLANLRLTDPQRFFLTCVSGEAGA
GRGSDAWGPPLLLEKDDRIVRTPPGPPLRLARNGSHQVTLRGFSKPSDLV
GVFSCVGGAGARRTRVIYVHNSPGAHLLPDKVTHTVNKGDTAVLSARVHK
EKTDVIWKSNGSYFYTLDWHEAQDGRFLLQLPNVQPPSSGIYSATYLEAS
PLGSAFFRLIVRGCGAGRWGPGCTKECPGCLHGGVCHDHDGECVCPPGFT
```

```
-continued
GTRCEQACREGRFGQSCQEQCPGISGCRGLTFCLPDPYGCSCGSGWRGSQ
CQEACAPGHFGADCRLQCQCQNGGTCDRFSGCVCPSGWHGVHCEKSDRIP
QILNMASELEFNLETMPRINCAAAGNPFPVRGSIELRKPDGTVLLSTKAI
VEPEKTTAEFEVPRLVLADSGFWECRVSTSGGQDSRRFKVNVKVPPVPLA
APRLLTKQSRQLVVSPLVSFSGDGPISTVRLHYRPQDSTMDWSTIVVDPS
ENVTLMNLRPKTGYSVRVQLSRPGEGGEGAWGPPTLMTTDCPEPLLQPWL
EGWHVEGTDRLRVSWSLPLVPGPLVGDGFLLRLWDGTRGQERRENVSSPQ
ARTALLTGLTPGTHYQLDVQLYHCTLLGPASPPAHVLLPPSGPPAPRHLH
AQALSDSEIQLTWKHPEALPGPISKYVVEVQVAGGAGDPLWIDVDRPEET
STIIRGLNASTRYLFRMRASIQGLGDWSNTVEESTLGNGLQAEGPVQESR
AAEEGLDQQLILAVVGSVSATCLTILAALLTLVCIRRSCLHRRRTFTYQS
GSGEETILQFSSGTLTLTRRPKLQPEPLSYPVLEWEDITFEDLIGEGNFG
QVIRAMIKKDGLKNNAAIKMLKEYASENDHRDFAGELEVLCKLGHHPNII
NLLGACKNRGYLYIAIEYAPYGNLLDFLRKSRVLETDPAFAREHGTASTL
SSRQLLRFASDAANGMQYLSEKQFIHRDLAARNVLVGENLASKIADFGLS
RGEEVYVKKTMGRLPVRWMAIESLNYSVYTTKSDVWSFGVLLWEIVSLGG
TPYCGMTCAELYEKLPQGYRMEQPRNCDDEVYELMRQCWRDRPYERPPFA
QIALQLGRMLEARKAYVNMSLFENFTYAGIDATAEEA
```

An exemplary nucleic acid sequence that encodes Tie1 is as follows:

```
                                                (SEQ ID NO: 1)
       atggtctggc gggtgccccc tttcttgctc cccatcctct tcttggcttc tcatgtgggc     60
       gcggcggtgg acctgacgct gctggccaac ctgcggctca cggaccccca gcgcttcttc    120
       ctgacttgcg tgtctgggga ggccggggcg gggaggggct cggacgcctg ggcccgccc     180
       ctgctgctgg agaaggacga ccgtatcgtg cgcacccgc  ccgggccacc cctgcgcctg    240
       gcgcgcaacg gttcgcacca ggtcacgctt cgcggcttct ccaagccctc ggacctcgtg    300
       ggcgtcttct cctgcgtggg cggtgctggg gcgcggcgca cgcgcgtcat ctacgtgcac    360
       aacagccctg gagcccacct gcttccagac aaggtcacac acactgtgaa caaaggtgac    420
       accgctgtac tttctgcacg tgtgcacaag gagaagcaga cagacgtgat ctggaagagc    480
       aacggatcct acttctacac cctggactgg catgaagccc aggatgggcg gttcctgctg    540
       cagctcccaa atgtgcagcc accatcgagc ggcatctaca gtgccactta cctggaagcc    600
       agcccctgg  gcagcgcctt ctttcggctc atcgtgcggg gttgtgggc  tgggcgctgg    660
       gggccaggct gtaccaagga gtgcccaggt tgcctacatg gaggtgtctg ccacgaccat    720
       gacggcgaat gtgtatgccc ccctggcttc actggcaccc gctgtgaaca ggcctgcaga    780
       gagggccgtt ttgggcagag ctgccaggag cagtgcccag gcatatcagg ctgccggggc    840
       ctcaccttct gcctcccaga ccctatggc  tgctcttgtg gatctggctg gagaggaagc    900
       cagtgccaag aagcttgtgc ccctggtcat tttggggctg attgccgact ccagtgccag    960
       tgtcagaatg gtggcacttg tgaccggttc agtggttgtg tctgcccctc tgggtggcat   1020
       ggagtgcact gtgagaagtc agaccggatc ccccagatcc tcaacatggc ctcagaactg   1080
```

-continued

```
gagttcaact tagagacgat gccccggatc aactgtgcag ctgcagggaa cccttcccc    1140
gtgcggggca gcatagagct acgcaagcca gacggcactg tgctcctgtc caccaaggcc    1200
attgtggagc cagagaagac cacagctgag ttcgaggtgc cccgcttggt tcttgcggac    1260
agtgggttct gggagtgccg tgtgtccaca tctggcggcc aagacagccg gcgcttcaag    1320
gtcaatgtga aagtgccccc cgtgcccctg gctgcacctc ggctcctgac caagcagagc    1380
cgccagcttg tggtctcccc gctggtctcg ttctctgggg atggacccat ctccactgtc    1440
cgcctgcact accggcccca ggacagtacc atggactggt cgaccattgt ggtggacccc    1500
agtgagaacg tgacgttaat gaacctgagg ccaaagacag gatacagtgt tcgtgtgcag    1560
ctgagccggc caggggaagg aggagagggg gcctggggc ctcccaccct catgaccaca    1620
gactgtcctg agcctttgtt gcagccgtgg ttggagggct ggcatgtgga aggcactgac    1680
cggctgcgag tgagctggtc cttgcccttg gtgcccgggc cactggtggg cgacggtttc    1740
ctgctgcgCC tgtgggacgg gacacggggg caggagcggc gggagaacgt ctcatccccc    1800
caggcccgca ctgccctcct gacgggactc acgcctggca cccactacca gctggatgtg    1860
cagctctacc actgcaccct cctgggcccg gcctcgcccc ctgcacacgt gcttctgccc    1920
cccagtgggc ctccagcccc ccgacacctc cacgcccagg ccctctcaga ctccgagatc    1980
cagctgacat ggaagcaccc ggaggctctg cctgggccaa tatccaagta cgttgtggag    2040
gtgcaggtgg ctgggggtgc aggagaccca ctgtggatag acgtggacag gcctgaggag    2100
acaagcacca tcatccgtgg cctcaacgcc agcacgcgct acctcttccg catgcgggcc    2160
agcattcagg ggctcgggga ctggagcaac acagtagaag agtccaccct gggcaacggg    2220
ctgcaggctg agggcccagt ccaagagagc cgggcagctg aagagggcct ggatcagcag    2280
ctgatcctgg cggtggtggg ctccgtgtct gccacctgcc tcaccatcct ggccgccctt    2340
ttaaccctgg tgtgcatccg cagaagctgc ctgcatcgga gacgcacctt cacctaccag    2400
tcaggctcgg gcgaggagac catcctgcag ttcagctcag ggaccttgac acttacccgg    2460
cggccaaaac tgcagcccga gccctgagc tacccagtgc tagagtggga ggacatcacc    2520
tttgaggacc tcatcgggga ggggaacttc ggccaggtca tccgggccat gatcaagaag    2580
gacgggctga agatgaacgc agccatcaaa atgctgaaag agtatgcctc tgaaaatgac    2640
catcgtgact ttgcgggaga actggaagtt ctgtgcaaat tggggcatca ccccaacatc    2700
atcaacctcc tggggggcctg taagaaccga ggttacttgt atatcgctat tgaatatgcc    2760
ccctacggga acctgctaga ttttctgcgg aaaagccggg tcctagagac tgacccagct    2820
tttgctcgag agcatgggac agcctctacc cttagctccc ggcagctgct gcgtttcgcc    2880
agtgatgcgg ccaatggcat gcagtacctg agtgagaagc agttcatcca cagggacctg    2940
gctgcccgga atgtgctggt cggagagaac ctagcctcca gattgcaga cttcggcctt    3000
tctcggggag aggaggttta tgtgaagaag acgatggggc gtctccctgt gcgctggatg    3060
gccattgagt ccctgaacta cagtgtctat accaccaaga gtgatgtctg gtcctttgga    3120
gtccttcttt gggagatagt gagccttgga ggtacaccct actgtggcat gacctgtgcc    3180
gagctctata aaaagctgcc ccagggctac cgcatggagc agcctcgaaa ctgtgacgat    3240
gaagtgtacg agctgatgcg tcagtgctgg cgggaccgtc cctatgagcg accccctttt    3300
gcccagattg cgctacagct aggccgcatg ctggaagcca ggaaggccta tgtgaacatg    3360
tcgctgtttg agaacttcac ttacgcgggc attgatgcca cagctgagga ggcctga      3417
```

Example 2

Selection and Primary Screening

We have used phage display to select Tie1-specific antibodies from a very large phage library that displays immunoglobulins as Fab fragments. To isolate antibodies specific to Tie1, a phage displayed Fab antibody library was selected against the Tie1 extracellular domain fused to human Fc or to a histidine purification tag.

Selection in solution was done using biotin labelled antigen which was captured on streptavidin coated magnetic beads (M-280-DYNAL). Selection on cells expressing Tie1 was performed using a KINGFISHER automated magnetic bead capture device. Selection on immobilized antigen was performed using Tie1-Fc coated onto immunotubes.

Several selection strategies were used:

Strategy 1: Round 1 (500 mM biotin labelled Tie1/magnetic beads), Round 2 ($1\times10^7$ Tie1 expressing cells/Kingfisher), Round 3 ($1\times10^7$ Tie1 expressing cells/Kingfisher)

Strategy 2: Round 1 (500 mM biotin labelled Tie1/magnetic beads), Round 2 ($1\times10^7$ Tie1 expressing cells/Kingfisher), (300 mM biotin labelled Tie1/magnetic beads)

Strategy 3: Round 1 (Tie1 Fc coated immunotubes at 5 µg/ml), Round 2 (Tie1-Fc coated immunotubes), Round 3 (Tie1 Fc coated immunotubes plus depletion with human IgG).

Library members recovered from the selection strategies were tested for antigen binding in phage ELISA. Each isolate was tested for binding to coated Tie1 Fc. Strategy 1 did not identify any binding clones whereas strategy 2 identified 13 positive clones (n=95). Strategy 3 identified 86 binding clones (n=95).

Sequence analysis of the selected clones were grouped on the basis of the CDR3 selected of the heavy chain and resulted in 23 different antibodies with unique VH-CDR3 sequences.

We reformatted the selected Fabs as completely human antibodies by recloning the VH and VL coding sequences from the display library vector into two vectors of a mammalian expression vector system. These vectors contain the human kappa constant domain and the human gamma-1 heavy chain constant region. The vectors were co-transfected into mammalian CHO-K1 cells for expression and production of the corresponding complete IgGs. These antibodies were characterized using several assays as described below, including:

1. Western blotting and immunoprecipitation of Tie1 transfected cells and primary human endothelial cells;
2. Immunofluorescence of Tie1 transfected cells and primary human endothelial cells;
3. Stimulation and inhibition of Tie1 in Ba/F3 cells and primary human endothelial cells; and
4. Immunostaining of human tissues.

We identified 23 antibodies that interact with Tie1. See also Table 1, below.

After sequence confirmation of the reformatted clones they were used in a transient transfection of Hek293T cells. After growth the IgG was purified from culture supernatants using a protein A column. The quality of purified IgG1 was determined using SDS-PAGE.

The specificity of the Tie1 specific IgG's can be determined in a whole cell ELISA on mouse lung microvascular endothelial cells (LEII) and LEII-Tie1 cells transfected with a Tie1 expression construct. Cells are seeded into 96 well plates at a density of 10,000 cells/well and were fixed using 4% paraformaldehyde. Staining and detection of binding of IgG1 to LEII cells are detected using standard labelling with a HRP conjugated rabbit anti human HRP and TMB staining. Binding of purified IgG1 to LEII-Tie1 transfected cells can also be corrected for Tie1 protein that is expressed endogenously. Alternatively cells that have little or no endogenous Tie1 can be used for the analysis.

At least one of the binding antibodies—E3—functions as a Tie1 activating antibody in the BaF3 cell bioassay. We studied Tie1 phosphorylation in response to E3 IgG treatment in transiently transfected COS1 cells and human primary endothelial cells. Our results indicate that E3 IgG activates the Tie1 receptor. The BaF3 cell bioassay (also referred to as the "Tie1/EpoR chimericBAF cell assay" may provide an indication of a ligand's ability to cross-link the Tie1 receptor. Because the assay is artificial, crosslinking of the non-naturally occurring Tie-Epo fusion proteins may or may not be predictive of a ligand's ability to modulate in vivo function.

E3 can be used, instead of possible natural ligands to characterize several functions of Tie1 in vitro and in vivo. The region of Tie1 which interacts with E3 can be the target for small molecular weight compounds for Tie1 activation or inhibition.

Although E3 functions in one particular Tie1 activating assay, E3 and other positives in this assay may also have inhibitory effect as to other functions or in other contexts. For example, E3 can inhibit tube formation by HUVEC cells. See below.

In addition, we found two antibodies that inhibit the survival effect conferred by E3 in the BaF3 cell bioassay. These two antibodies may inhibit dimerization of Tie1 induced by E3 in the BaF3 assay. Two antibodies, B2 and D11, completely blocked the viability of Tie1/EpoR cells when used in combination with E3.

Methods

Cell Culture

COS1 cells were cultured in Dulbecco's modified Eagle's medium (DMEM) supplemented with 10% fetal calf serum (FCS), glutamine and antibiotics. The murine Ba/F3 pre-B lymphocytes were cultured in DMEM supplemented with 10% FCS, glutamine, antibiotics and 2 ng/ml interleukin-3 (Calbiochem). Human dermal microvascular endothelial cells (HDMVECs), obtained from PromoCell (Heidelberg, Germany) were cultured in endothelial cell medium provided by the supplier and used at passages 4-7.

Western Blotting and Immunoprecipitation

COS1 cells were transfected with pcDNA3-Tie1-V5 (1 µg DNA per 10 cm cell culture plate) using FUGENE 6 (Roche) according to manufacturer's instruction and incubated for 48 h before stimulation. For immunoprecipitation, Tie1 transfected cells and HMVEC cells were lysed in DOC-RIPA lysis buffer (50 mM Tris-HCl pH 8.0, 150 mM NaCl, 1% Triton-X-100, 0.1% SDS, 1% DOC, 10 mM EDTA) supplemented with aprotinin, leupeptin, PMSF and sodium vanadate. Immunoprecipitation was carried out from equal amount of cell lysates by incubating with polyclonal anti-human Tie1 antibodies (R&D), monoclonal anti-V5 antibodies (Invitrogen) or altogether 23 anti-Tie1 antibodies (1 µg/ml) for 1 to 2 h followed by incubation with protein G-Sepharose (Amersham Pharmacia Biotech AB) for 1 h. The immunoprecipitates were washed twice with PBS-T and twice with PBS, followed by elution with the Laemmli buffer and separation in 8% SDS-PAGE. The blots were probed with the 23 anti-Tie1 antibodies (5 µg/ml) and subsequently anti-human Fc antibodies conjugated with HRP.

Immunofluorescence Staining

COS1 cells on the glass coverslips were transiently transfected with pcDNA3-Tie1-V5 (the V5-epitope was added to the 3' terminus of pcDNA3-Tie1) (1 μg DNA per 10 cm cell culture plate) using FUGENE™ 6 (Roche) according to manufacturer's instruction and incubated for 48 h before staining. Cells were fixed in 4% paraformaldehyde for 10 min at 4° C. If required, the cells were permeabilized with 0.2% Triton X-100 in PBS for 5 min. Unspecific binding sites were blocked by incubation with 1% BSA in PBS for 30 min. The cells were then stained with anti-Tie1 antibodies (5 μg/ml) and anti-V5 antibodies for 1 h at room temperature, followed by incubation with FITC— conjugated anti-human antibodies (DAKO, 40 μg/ml) and TRITC-conjugated anti-mouse antibodies (DAKO, 15 μg/ml) for 30 min. Hoechst 33258 fluorochrome (Sigma, 0.5 μg/ml) was used for the staining of the nuclei.

Ba/F3 Bioassay

To generate Tie1-EpoR expressing Ba/F3 cells for the bioassay, Ba/F3 pre-B cells were stably transfected with a nucleic acid that expresses chimeric receptor containing the extracellular domain of human Tie1 fused with the transmembrane and cytoplasmic domains of the mouse erythropoietin receptor. The nucleic acid used was a Tie1-EpoR chimeric cDNA in a pEF-BOS expression vector. The nucleic acid encoding the chimeric receptor was constructed by cloning the PCR amplified extracellular part of human Tie1 (bp 37-2316 of X60975) as EcoRI-BglII fragment into mEpoR-pcDNA vector. The cDNA encoding for the chimeric receptor consisting of the extracellular part of Tie1 fused with the transmembrane and intracellular domains of EpoR was subcloned into the pEF-BOS expression vector. Vector was linearized and co-transfected into Ba/F3 cells with pcDNA3.1 (+) Zeo vector (Invitrogen). Stable cell pools were generated by selection with 250 μg/ml Zeocin. The expression of Tie1/EpoR fusion protein in several clones was analyzed by Western blotting with an antibody against EpoR.

To perform the assays, Ba/F3 cells expressing the Tie 1-EpoR chimera were split in 96-well microtiter plates at 50 000 cells/well in the presence of the indicated concentrations of anti-Tie1 antibodies. As controls, Zeocin resistant pools not expressing the Tie1-EpoR were used. After 48 h, the viability of the cells was determined by adding MTT (3-(4, 5-dimethylthiazol-2-yl)-2,5-diphenyl tetrazolium bromide (Sigma), 0.5 mg/ml), followed by further 2 h of culture, addition of an equal volume of cell lysis solution (10% SDS, 10 mM HCl) and incubation overnight at 37° C. Absorbance was measured at 540 nm.

Tie1 Phosphorylation Assay

COS1 cells were transfected with pcDNA3-Tie1-V5. After 24 h of transfection, the cells were serum starved for 8 h and then treated with E3 IgG. For the Tie1 phosphorylation assay, HDMVECs were cultured on 10 cm dishes to near confluence, starved (8-16 h) in serum free medium and stimulated as indicated. After the stimulations, the cells were lysed in lysis buffer (RIPA-DOC: 50 mM Tris-HCl pH 8.0, 150 mM NaCl, 1% Triton-X-100, 0.1% SDS, 0.5% DOC, 10 mM EDTA, supplemented with aprotinin, leupeptin, PMSF and sodium vanadate). Clarified lysates from transfected COS1 cells or HDMVECs were immunoprecipitated with anti-V5 or anti-Tie1 B9, respectively. Proteins were separated by SDS-PAGE, transferred to nitrocellulose and immunoblotted using the anti-phosphotyrosine and anti-Tie1 (R&D systems) antibodies.

Immunostaining of Human Tissues

To evaluate reactivity of anti-Tie1 antibodies in immunohistochemistry, 5 μm cryosections of human kidney and lung were dried at room temperature for 30 min and fixed with cold acetone for 10 min. Slides were washed with PBS and treated with 0.03% $H_2O_2$ in PBS for 15 min to reduce endogenous peroxidase activity. TNB (30 min at room temperature) was used to block non-specific binding and sections were incubated with Tie1 antibodies at concentration of 10 μl/g/ml overnight at +4° C. After several washings with PBS, biotinylated anti human antibody (1:300, Zymed) was added to the tissues. Signal was amplified by using a TSA kit and detected with AEC staining.

Results

Western blotting, immunoprecipitation and immunofluorescence of Tie1 transfected cells and primary human endothelial cells (see Table 1).

TABLE 1

Assay Summary

| Clone | WB: Tie1-transfected | WB: HDMEC | IP: Tie1-transfected | IP: HDMEC | IF: Tie1-transfected | IF: HDMEC | BaF3 assay |
|---|---|---|---|---|---|---|---|
| E3 | + | + | ND | − | + | + | + |
| G2 | + | + | ++ | + | + | ++ | − |
| A2 | + | + | ++ | + | + | ++ | − |
| A10 | + | + | ++ | + | + | + | − |
| B2 | + | + | + | − | + | + | − |
| B9 | + | + | ++ | ++ | ++ | + | − |
| C2 | + | + | ++ | ++ | + | ++ | − |
| C7 | + | + | ++ | + | + | + | − |
| C10 | + | + | ++ | ++ | ++ | + | − |
| D11 | + | + | + | − | + | ++ | − |
| E11 | + | + | ++ | + | + | ++ | − |
| G10 | + | + | ++ | + | ++ | + | − |
| H1 | + | + | ++ | + | ++ | + | − |
| H4 | + | + | ++ | + | + | + | − |
| P-A1 | + | + | ++ | ++ | + | ++ | − |
| P-A10 | + | + | ++ | − | + | + | − |
| P-B1 | + | + | + | − | weak | + | − |
| P-B3 | + | + | − | − | + | + | − |
| P-C6 | + | + | + | − | + | ++ | − |
| P-D12 | + | + | + | − | + | + | − |
| P-F3 | + | + | − | − | ++ | ++ | − |

TABLE 1-continued

Assay Summary

| Clone | WB: Tie1-transfected | WB: HDMEC | IP: Tie1-transfected | IP: HDMEC | IF: Tie1-transfected | IF: HDMEC | BaF3 assay |
|---|---|---|---|---|---|---|---|
| P-F4 | + | + | ++ | − | cross | ++ | − |
| P-G3 | + | + | ++ | + | + | + | − |
| PH1 | − | − | − | − | − | − | − |

To confirm the binding ability of the 23 selected anti-Tie1 antibodies, we first performed western blotting and immunoprecipitation using COS1 cells transfected with pcDNA3-Tie1-V5 (V5 tagged) and primary endothelial cells. Next, to find out if the anti-Tie1 antibodies recognize Tie1 in living cells, those cells were studied by immunofluorescence staining. All the antibodies analyzed recognized both transfected and endogenous Tie1, although differences were detected in the binding affinity as shown in Table 1.

Stimulation and Inhibition of Tie1 in Tie1-EpoR Transfected Ba/F3 Cells and Human Primary Endothelial Cells Although no ligand for Tie1 has been identified, we used the following efficient screening method for Tie1-binding proteins. Interleukin-3 dependent pre-B-lymphocyte (Ba/F3) cells were transfected with a construct that expresses a Tie1-EpoR fusion protein. Since Ba/F3 cells are IL-3 dependent, they die unless IL-3 is provided. However, Tie-EpoR receptor expressing Ba/F3 cells can survive and proliferate if the medium contains a Tie1-binding protein, either a natural ligand or an artificial mimetic. Cell survival can be quantitated, e.g., by colorimetric MTT-assay, which measures mitochondrial activity.

The results from the BaF3 cell assays indicated that, of the 23 different monoclonal antibodies tested, only E3 IgG was able to promote survival of Tie1-EpoR cells whereas the viability of EpoR Ba/F3 cells used as a control was not affected by E3 IgG. The IgG part of the immunoglobulin molecule was needed for the survival effect of E3 IgG, as the E3 Fab fragment had no effect on the viability of Tie1-EpoR cells. A concentration of 50 ng/ml of E3 IgG gave almost maximal viability in Tie1-EpoR cell survival assays.

To test if the E3 IgG binding to the extracellular region of Tie1 induces autophosphorylation of Tie1, the Tie1 receptor phosphorylation level in response to E3 IgG treatment was studied in transiently transfected COS1 cells and human primary endothelial cells. COS1 cells were transfected with an expression vector containing a V5-tagged full length Tie1 cDNA, and, after serum starvation, the cells were treated with E3 IgG (200 ng/ml). Cell lysates were extracted at several time points and Tie1 was immunoprecipitated with anti-V5 followed by western blotting using anti-phosphotyrosine and anti-Tie1 antibodies. The results indicated that Tie1 is tyrosine phosphorylated after 10 to 30 min of E3 IgG stimulation. To determine if E3 IgG induces Tie1 phosphorylation in primary endothelial cells, HDMVEC cells were serum starved and stimulated with several concentrations of E3 for 60 min. Tie1 was then immunoprecipitated from cell lysates and subjected to anti-phosphotyrosine blotting analysis, which showed receptor phosphorylation following E3 IgG stimulation at 50-200 ng/ml. Also higher concentrations of E3 (500-1000 ng/ml) induced Tie1 phosphorylation but the response was more rapid and was most prominent after 5 min of stimulation.

To study the kinetics of E3 IgG induced Tie1 activation, cells were stimulated with E3 IgG (200 ng/ml) and receptor phosphorylation was studied at various time points. Tie1 phosphorylation was highest 15-30 min after E3 IgG treatment but phosphorylation persisted for up to 1 h.

To determine if any of the other monoclonal antibodies tested inhibit the survival effect of E3 IgG in Tie1-EpoR Ba/F3 assay, antibodies were studied in combination with E3 IgG. A concentration of 100 ng/ml of E3 IgG together with 100 (1:1) or 500 (1:5) ng/ml of the other antibodies were used and the viability of Tie1-EpoR cells was measured. The results from both combinations of E3 IgG and the test antibody (in 1:1 and 1:5 ratios) were similar and indicated that two of the 23 antibodies (B2 and D11) blocked completely the survival effect of E3 IgG (Table 2). Several antibodies (A2, A10, P-B1, P-B3 and P-C6) inhibited the viability effect of E3 IgG to some extent and two of the antibodies (G2 and C7) promoted the survival of Tie1/EpoR Ba/F3 cells in combination with E3 IgG.

TABLE 2

BaF3 Assay

| Treatment | Average MTT activity in BaF3 cell assay | St. Dev. |
|---|---|---|
| IL3, 2 | 0.48 | 0.038 |
| 0 | 0.01 | 0.003 |
| E3 | 0.61 | 0.032 |
| E3 + G2 | 0.74 | 0.034 |
| E3 + A2 | 0.38 | 0.016 |
| E3 + A10 | 0.52 | 0.011 |
| E3 + B2 | 0.00 | 0.001 |
| E3 + B9 | 0.65 | 0.011 |
| E3 + C2 | 0.62 | 0.016 |
| E3 + C7 | 0.84 | 0.086 |
| E3 + C10 | 0.67 | 0.004 |
| E3 + D11 | 0.01 | 0.003 |
| E3 + E11 | 0.61 | 0.048 |
| E3 + G10 | 0.65 | 0.010 |
| E3 + H1 | 0.60 | 0.017 |
| E3 + H4 | 0.65 | 0.026 |
| E3 + PA1 | 0.60 | 0.035 |
| E3 + PA10 | 0.65 | 0.041 |
| E3 + PB1 | 0.47 | 0.011 |
| E3 + P-B3 | 0.51 | 0.007 |
| E3 + PC6 | 0.35 | 0.008 |
| E3 + PD12 | 0.60 | 0.038 |
| E3 + PF3 | 0.55 | 0.032 |
| E3 + PF4 | 0.56 | 0.009 |
| E3 + PG3 | 0.77 | 0.030 |
| E3 + PH1 | 0.63 | 0.040 |

Immunostaining of Human Tissues

The anti-Tie1 antibodies react with human Tie1 in cultured cells. It is also possible to determine whether they could stain human tissue samples from lung and kidney as well as from tumors by using biotinylated anti-Tie1 antibodies and detecting bound antibodies using labeled streptavidin or avidin.

Example 3

Exemplary Sequences

The following are sequences of exemplary immunoglobulin variable domains:

```
Translation of Reverse_Complement_VH-PA1-Tie1-phagemid.TXT(1-396)
Universal code
Total amino acid number: 132, MW=14169
Max ORF: 1-396, 132 AA, MW=14169
1   GAAGTTCAATTGTTAGAGTCTGGTGGCGGTCTTGTTCAGCCTGGTGGTTCTTTACGTCTT  (SEQ ID NO: 3)
1    E  V  Q  L  L  E  S  G  G  G  L  V  Q  P  G  G  S  L  R  L    (SEQ ID NO: 4)

61  TCTTGCGCTGCTTCCGGATTCACTTTCTCTATTTACAAGATGTCTTGGGTTCGCCAAGCT
21   S  C  A  A  S  G  F  T  F  S  I  Y  K  M  S  W  V  R  Q  A

121 CCTGGTAAAGGTTTGGAGTGGGTTTCTTCTATCTATCCTTCTGGTGGCCAGACTAAGTAT
41   P  G  K  G  L  E  W  V  S  S  I  Y  P  S  G  G  Q  T  K  Y

181 GCTGACTCCGTTAAAGGTCGCTTCACTATCTCTAGAGACAACTCTAAGAATACTCTCTAC
61   A  D  S  V  K  G  R  F  T  I  S  R  D  N  S  K  N  T  L  Y

241 TTGCAGATGAACAGCTTAAGGGCTGAGGACACTGCAGTCTACTATTGTGCGAGAGTCAAT
81   L  Q  M  N  S  L  R  A  E  D  T  A  V  Y  Y  C  A  R  V  N

301 TACTATGATAGTAGTGGTTACGGTCCTATAGCTCCTGGACTTGACTACTGGGGCCAGGGA
101  Y  Y  D  S  S  G  Y  G  P  I  A  P  G  L  D  Y  W  G  Q  G

361 ACCCTGGTCACCGTCTCAAGCGCCTCCACCAAGGGC
121  T  L  V  T  V  S  S  A  S  T  K  G

Translation of VL-PA1-Tie1-phagemid.TXT(1-311)
Universal code
Total amino acid number: 103, MW=11169
Max ORF: 1-309, 103 AA, MW=11169
1   CAAGACATCCAGATGACCCAGTCTCCAGGCACCCTGTCTTTGTCTCCAGGGGAAAGAGCC  (SEQ ID NO: 5)
1    Q  D  I  Q  M  T  Q  S  P  G  T  L  S  L  S  P  G  E  R  A    (SEQ ID NO: 6)

61  ACCCTCTCCTGCAGGGCCAGTCAGAGTGTTAGCAGCAGCTACTTAGCCTGGTACCAGCAG
21   T  L  S  C  R  A  S  Q  S  V  S  S  S  Y  L  A  W  Y  Q  Q

121 AAACCTGGCCAGGCTCCCAGGCTCCTCATCTATGGTGCATCCAGCAGGGCCACTGGCATC
41   K  P  G  Q  A  P  R  L  L  I  Y  G  A  S  S  R  A  T  G  I

181 CCAGACAGGTTCAGTGGCAGTGGGTCTGGGACAGACTTCACTCTCACCATCAGCAGACTG
61   P  D  R  F  S  G  S  G  S  G  T  D  F  T  L  T  I  S  R  L

241 GAGCCTGAAGATTTTGCAGTGTATTACTGTCAGCAGTATGGTAGCTCCCGGTGGACGTTC
81   E  P  E  D  F  A  V  Y  Y  C  Q  Q  Y  G  S  S  R  W  T  F

301 GGCCAAGGGAC
101  G  Q  G

Translation of Reverse_Complement_VH-PA5-Tie1-phagemid.TXT(1-396)
Universal code
Total amino acid number: 132, MW=14309
Max ORF: 1-396, 132 AA, MW=14309
1   GAAGTTCAATTGTTAGAGTCTGGTGGCGGTCTTGTTCAGCCTGGTGGTTCTTTACGTCTT  (SEQ ID NO: 7)
1    E  V  Q  L  L  E  S  G  G  G  L  V  Q  P  G  G  S  L  R  L    (SEQ ID NO: 8)

61  TCTTGCGCTGCTTCCGGATTCACTTTCTCTATTTACAAGATGTCTTGGGTTCGCCAAGCT
21   S  C  A  A  S  G  F  T  F  S  I  Y  K  M  S  W  V  R  Q  A

121 CCTGGTAAAGGTTTGGAGTGGGTTTCTTCTATCTATCCTTCTGGTGGCCAGACTAAGTAT
41   P  G  K  G  L  E  W  V  S  S  I  Y  P  S  G  G  Q  T  K  Y

181 GCTGACTCCGTTAAAGGTCGCTTCACTATCTCTAGAGACAACTCTAAGAATACTCTCTAC
61   A  D  S  V  K  G  R  F  T  I  S  R  D  N  S  K  N  T  L  Y

241 TTGCAGATGAACAGCTTAAGGGCTGAGGACACTGCAGTCTACTATTGTGCGAGAGTCAAT
81   L  Q  M  N  S  L  R  A  E  D  T  A  V  Y  Y  C  A  R  V  N

301 TACTATGATAGTAGTGGTTACGGTCCTATAGCTCCTGGACTTGACTACTGGGGCCAGGGA
101  Y  Y  D  S  S  G  Y  G  P  I  A  P  G  L  D  Y  W  G  Q  G

361 ACCCTGGTCACCGTCTCAAGCGCCTCCACCAAGGGC
121  T  L  V  T  V  S  S  A  S  T  K  G
```

-continued

Translation of VL-PA5-Tie1-phagemid.TXT(1-308)
Universal code
Total amino acid number: 101, MW=10801
Max ORF: 85-306, 74 AA, MW=7983

```
1   CAACACATCCACATCACCCACTCTCCATCCTCCCTCTCTCCATCTCTCCCACACACAGTC  (SEQ ID NO: 9)
1   Q   D   I   Q   M   T   Q   S   P   S   S   L   S   A   S   V   G   D   R   V   (SEQ ID NO: 10)

61  ACCATCACTTCCCCCCCAACTTACACCATTACCACCTCTTTAAATTCCTATCACCAAAAA
21  T   I   T   C   R   A   S   *   S   I   S   T   S   L   N   W   Y   Q   Q   K

121 TCACCCAAACCCCCTAACCTCCTCATATATGCTCCATCCACTTTCCAAACTCAACTCCCA
41  S   G   K   A   P   K   L   L   I   Y   A   A   S   S   L   Q   S   E   V   P

181 TCAACCTTCACTCCCACTCCATCTCCCACACATTTCACTCTCACCATCACCACTCTCCAA
61  S   R   F   S   G   S   G   S   G   T   D   F   T   L   T   I   T   S   L   Q

241 CCTCAACATTTTCCAACTTACTACTCTCAACACACTTACACTACCCCTCCCACTTTCCCC
81  P   E   D   F   A   T   Y   Y   C   Q   Q   S   Y   S   T   P   P   T   F   G

301 CAACCCAC
101 Q   G
```

Translation of VH-PA6-Tie1-phagemid.TXT(1-439)
Universal code
Total amino acid number: 146, MW=15647
Max ORF: 1-438, 146 AA, MW=15647

```
1   GAAGTTCAATTGTTAGAGTCTGGTGGCGGTCTTGTTCAGCCTGGTGGTTCTTTACGTCTT  (SEQ ID NO: 11)
1   E   V   Q   L   L   E   S   G   G   G   L   V   Q   P   G   G   S   L   R   L   (SEQ ID NO: 12)

61  TCTTGCGCTGCTTCCGGATTCACTTTCTCTATGTACGTTATGAAGTGGGTTCGCCAAGCT
21  S   C   A   A   S   G   F   T   F   S   M   Y   V   M   K   W   V   R   Q   A

121 CCTGGTAAAGGTTTGGAGTGGGTTTCTTCTATCTATCCTTCTGGTGGCTATACTCGTTAT
41  P   G   K   G   L   E   W   V   S   S   I   Y   P   S   G   G   Y   T   R   Y

181 GCTGACTCCGTTAAAGGTCGCTTCACTATCTCTAGAGACAACTCTAAGAATACTCTCTAC
61  A   D   S   V   K   G   R   F   T   I   S   R   D   N   S   K   N   T   L   Y

241 TTGCAGATGAACAGCTTAAGGGCTGAGGACACTGCAGTCTACTATTGTGCGAGAGTCAAT
81  L   Q   M   N   S   L   R   A   E   D   T   A   V   Y   Y   C   A   R   V   N

301 TACTATGATAGTAGTGGTTACGGTCCTATAGCTCCTGGACTTGACTACTGGGGCCAGGGA
101 Y   Y   D   S   S   G   Y   G   P   I   A   P   G   L   D   Y   W   G   Q   G

361 ACCCTGGTCACCGTCTCAAGCGCCTCCACCAAGGGCCCATCGGTCTTCCCGCTAGCACCC
121 T   L   V   T   V   S   S   A   S   T   K   G   P   S   V   F   P   L   A   P

421 TCCTCCAAGAGCACCTCTG
141 S   S   K   S   T   S
```

Translation of VL-PA6-Tie1-phagemid.TXT(1-311)
Universal code
Total amino acid number: 103, MW=11056
Max ORF: 1-309, 103 AA, MW=11056

```
1   CAAGACATCCAGATGACCCAGTCTCCAGGCACCCTGTCTTTGTCTCCAGGGGAAAGAGCC  (SEQ ID NO: 13)
1   Q   D   I   Q   M   T   Q   S   P   G   T   L   S   L   S   P   G   E   R   A   (SEQ ID NO: 14)

61  ACCCTCTCCTGCAGGGCCAGTCAGAGTGTTAGCAGCAGCTACTTAGCCTGGTACCAGCAG
21  T   L   S   C   R   A   S   Q   S   V   S   S   S   Y   L   A   W   Y   Q   Q

121 AAACCTGGCCAGGCTCCCAGGCTCCTCATCTATGGTGCATCCAGCAGGGCCACTGGCATC
41  K   P   G   Q   A   P   R   L   L   I   Y   G   A   S   S   R   A   T   G   I

181 CCAGACAGGTTCAGTGGCAGTGGGTCTGGGACAGACTTCACTCTCACCATCAGCAGACTG
61  P   D   R   F   S   G   S   G   S   G   T   D   F   T   L   T   I   S   R   L

241 GAGCCTGAAGATTTTGCAGTGTATTACTGTCAGCAGTATGGTAGCTCCCTATTCACTTTC
81  E   P   E   D   F   A   V   Y   Y   C   Q   Q   Y   G   S   S   L   F   T   F

301 GGCCCTGGGAC
101 G   P   G
```

-continued

Translation of VH-PA10-Tie1-phagemid.TXT(1-439)
Universal code
Total amino acid number: 146, MW=15499
Max ORF: 1-438, 146 AA, MW=15499

```
1   GAAGTTCAATTGTTAGAGTCTGGTGGCGGTCTTGTTCAGCCTGGTGGTTCTTTACGTCTT    (SEQ ID NO: 15)
1    E  V  Q  L  L  E  S  G  G  G  L  V  Q  P  G  G  S  L  R  L    (SEQ ID NO: 16)

61  TCTTGCGCTGCTTCCGGATTCACTTTCTCTTCTTACAAGATGGGTTGGGTTCGCCAAGCT
21   S  C  A  A  S  G  F  T  F  S  S  Y  K  M  G  W  V  R  Q  A

121 CCTGGTAAAGGTTTGGAGTGGGTTTCTTGGATCTATCCTTCTGGTGGCGGTACTACTTAT
41   P  G  K  G  L  E  W  V  S  W  I  Y  P  S  G  G  G  T  T  Y

181 GCTGACTCCGTTAAAGGTCGCTTCACTATCTCTAGAGACAACTCTAAGAATACTCTCTAC
61   A  D  S  V  K  G  R  F  T  I  S  R  D  N  S  K  N  T  L  Y

241 TTGCAGATGAACAGCTTAAGGGCTGAGGACACTGCAGTCTACTATTGTGCGAGAGTCAAT
81   L  Q  M  N  S  L  R  A  E  D  T  A  V  Y  Y  C  A  R  V  N

301 TACTATGATAGTAGTGGTTACGGTCCTATAGCTCCTGGACTTGACTACTGGGGCCAGGGA
101  Y  Y  D  S  S  G  Y  G  P  I  A  P  G  L  D  Y  W  G  Q  G

361 ACCCTGGTCACCGTCTCAAGCGCCTCCACCAAGGGCCCATCGGTCTTCCCGCTAGCACCC
121  T  L  V  T  V  S  S  A  S  T  K  G  P  S  V  F  P  L  A  P

421 TCCTCCAAGAGCACCTCTG
141  S  S  K  S  T  S
```

Translation of VL-PA10-Tie1-phagemid.TXT(1-311)
Universal code
Total amino acid number: 103, MW=11110
Max ORF: 1-309, 103 AA, MW=11110

```
1   CAAGACATCCAGATGACCCAGTCTCCAGGCACCCTGTCTTTGTCTCCAGGGGAAAGAGCC    (SEQ ID NO: 17)
1    Q  D  I  Q  M  T  Q  S  P  G  T  L  S  L  S  P  G  E  R  A    (SEQ ID NO: 18)

61  ACCCTCTCCTGCAGGGCCAGTCAGAGTGTTAGCAGCAGCTACTTAGCCTGGTACCAGCAG
21   T  L  S  C  R  A  S  Q  S  V  S  S  S  Y  L  A  W  Y  Q  Q

121 AAACCTGGCCAGGCTCCCAGGCTCCTCATCTATGGTGCATCCAGCAGGGCCACTGGCATC
41   K  P  G  Q  A  P  R  L  L  I  Y  G  A  S  S  R  A  T  G  I

181 CCAGACAGGTTCAGTGGCAGTGGGTCTGGGACAGACTTCACTCTCACCATCAGCAGACTG
61   P  D  R  F  S  G  S  G  S  G  T  D  F  T  L  T  I  S  R  L

241 GAGCCTGAAGATTTTGCAGTGTATTACTGTCAGCAGTATGGTAGCTCACCGTGGACGTTC
81   E  P  E  D  F  A  V  Y  Y  C  Q  Q  Y  G  S  S  P  W  T  F

301 GGCCAAGGGAC
101  G  Q  G
```

Translation of VH-PB1-Tie1-phagemid.TXT(1-446)
Universal code
Total amino acid number: 148, MW=15809
Max ORF: 1-444, 148 AA, MW=15809

```
1   GAAGTTCAATTGTTAGAGTCTGGTGGCGGTCTTGTTCAGCCTGGTGGTTCTTTACGTCTT    (SEQ ID NO: 19)
1    E  V  Q  L  L  E  S  G  G  G  L  V  Q  P  G  G  S  L  R  L    (SEQ ID NO: 20)

61  TCTTGCGCTGCTTCCGGATTCACTTTCTCTCGTTACCCTATGGTTTGGGTTCGCCAAGCT
21   S  C  A  A  S  G  F  T  F  S  R  Y  P  M  V  W  V  R  Q  A

121 CCTGGTAAAGGTTTGGAGTGGGTTTCTGTTATCTCCTTCTGGTGGCCAGACTTTTTAT
41   P  G  K  G  L  E  W  V  S  V  I  S  P  S  G  G  Q  T  F  Y

181 GCTGACTCCGTTAAAGGTCGCTTCACTATCTCTAGAGACAACTCTAAGAATACTCTCTAC
61   A  D  S  V  K  G  R  F  T  I  S  R  D  N  S  K  N  T  L  Y

241 TTGCAGATGAACAGCTTAAGGGCTGAGGACACTGCAGTCTACTATTGTGCGAGAGGGGTC
81   L  Q  M  N  S  L  R  A  E  D  T  A  V  Y  Y  C  A  R  G  V

301 CTCACCACCGCTTTTGATATCTGGGGCCAAGGGACAATGGTCACCGTCTCAAGCGCCTCC
101  L  T  T  A  F  D  I  W  G  Q  G  T  M  V  T  V  S  S  A  S

361 ACCAAGGGCCCATCGGTCTTCCCGCTAGCACCCTCCTCCAAAGCACCTCTGGGGGCACAG
121  T  K  G  P  S  V  F  P  L  A  P  S  S  K  A  P  L  G  A  Q

421 CGGCCCTGGGCTGCCTGGTCAAGGAC
141  R  P  W  A  A  W  S  R
```

-continued

Translation of VL-PB1-Tie1-phagemid.TXT(1-308)
Universal code
Total amino acid number: 102, MW=11057
Max ORF: 1-306, 102 AA, MW=11057

```
1   CAAGACATCCAGATGACCCAGTCTCCATCCTCCCTGTCTGCATCTGTGGGAGACAGAGTC   (SEQ ID NO: 21)
1    Q  D  I  Q  M  T  Q  S  P  S  S  L  S  A  S  V  G  D  R  V    (SEQ ID NO: 22)

61  ACCATCACTTGCCGGGCAAGTCAGAACATTAACAGCTATTTAAATTGGTATCAGCAGAAA
21   T  I  T  C  R  A  S  Q  N  I  N  S  Y  L  N  W  Y  Q  Q  K

121 CCAGGGCAAGCCCCTAAACTCCTGATCTATGCTGCCTCCAATTTGGAAACTGCGGTCCCA
41   P  G  Q  A  P  K  L  L  I  Y  A  A  S  N  L  E  T  A  V  P

181 TCAAGGTTCAGCGGCAGTGGATCTGGGACAGATTTCACTCTCACCATCAGTAGCCTGCAG
61   S  R  F  S  G  S  G  S  G  T  D  F  T  L  T  I  S  S  L  Q

241 CCTGAAGATTTTGCAACTTATTATTGTCAACAATTTAATACTTACCCTCTCACTTTCGGC
81   P  E  D  F  A  T  Y  Y  C  Q  Q  F  N  T  Y  P  L  T  F  G

301 GGAGGGAC
101  G  G
```

Translation of VH-PB3-Tie1-phagemid.TXT(1-393)
Universal code
Total amino acid number: 131, MW=13931
Max ORF: 1-393, 131 AA, MW=13931

```
1   CAACTTCAATTGTTAGAGTCTCGTGGCGGTCTTCTTCACCCTGCTGCTTCTTTACGTCTT   (SEQ ID NO: 23)
1    E  V  Q  L  L  E  S  G  G  G  L  V  Q  P  G  G  S  L  R  L    (SEQ ID NO: 24)

61  TCTTCCGCTGCTTCCGGATTCACTTTCTCTCGTTACGGCTATCCATTGGCTTCGCCAACCT
21   S  C  A  A  S  G  F  T  F  S  R  Y  G  M  H  W  V  R  Q  A

121 CCTCGTAAACGTTTGGACTGGGTTTCTGTTATCTCTCCTTCTGCTGCCATGACTTATTAT
41   P  G  K  G  L  E  W  V  S  V  I  S  P  S  G  G  M  T  Y  Y

181 CCTGACTCCGTTAAAGCTCCCTTCACTATCTCTACAGACAACACTAAGAATACTCTCTAC
61   A  D  S  V  K  G  R  F  T  I  S  R  D  N  T  K  N  T  L  Y

241 TTCCACATCAACACCTTAACCCCTCACCACACTCCACTCTACTATTCTCCCACACTCCCA
81   L  Q  M  N  S  L  R  A  E  D  T  A  V  Y  Y  C  A  R  V  G

301 CCTACCCCCCCTTTTGATATCTCCCCCCAACCCACAATCCTCACCCTCTCAACCCCCTCC
101  A  T  G  P  F  D  I  W  G  Q  G  T  M  V  T  V  S  S  A  S

361 ACCAAGCCCCCATCCGTCTTCCCGCTACCACCC
121  T  K  G  P  S  V  F  P  L  A  P
```

Translation of VL-PB3-Tie1-phagemid.TXT(1-308)
Universal code
Total amino acid number: 102, MW=11032
Max ORF: 1-306, 102 AA, MW=11032

```
1   CAACACATCCACATCACCCAGTCTCCAGCCACCCTCTCTTTCTCTCCACCCGAAAGAGCC   (SEQ ID NO: 25)
1    Q  D  I  Q  M  T  Q  S  P  A  T  L  S  L  S  P  G  E  R  A    (SEQ ID NO: 26)

61  ACCCTCTCCTCCAGCGCCACTCAGAGTCTTACCACCTACTTACCCTCCTACCAACACAAA
21   T  L  S  C  R  A  S  Q  S  V  S  T  Y  L  A  W  Y  Q  Q  K

121 CCTCCCCACCCTCCCACCCTTCTCATCTATCATGCATCCAACACCGCCACTCGCATCCCA
41   P  G  Q  A  P  R  L  L  I  Y  D  A  S  N  R  A  T  G  I  P

181 CGCAGCTTCACTGGCACTGGGTCTCCGACACACTTCACTCTCACCATCACCAGCCTAGAC
61   G  R  F  S  G  S  G  S  G  T  D  F  T  L  T  I  S  S  L  E

241 CCTCAAGACTTTGCACTTTATTACTCTCACCACCCTACCACCTCCCCCATCACCTTCGCC
81   A  E  D  F  A  V  Y  Y  C  Q  Q  R  S  S  W  P  I  T  F  G

301 CAACCCAC
101  Q  G
```

Translation of VH-PC6-Tie1-phagemid.TXT(1-429)
Universal code
Total amino acid number: 143, MW=14727
Max ORF: 1-429, 143 AA, MW=14727

```
1   GAAGTTCAATTGTTAGAGTCTGGTGGCGGTCTTGTTCAGCCTGGTGGTTCTTTACGTCTT   (SEQ ID NO: 27)
1    E  V  Q  L  L  E  S  G  G  G  L  V  Q  P  G  G  S  L  R  L    (SEQ ID NO: 28)

61  TCTTGCGCTGCTTCCGGATTCACTTTCTCTCATTACGGTATGACTTGGGTTCGCCAAGCT
21   S  C  A  A  S  G  F  T  F  S  H  Y  G  M  T  W  Y  R  Q  A
```

```
                            -continued
121 CCTGGTAAAGGTTTGGAGTGGGTTTCTGTTATCTCTCCTTCTGGTGGCCAGACTGGTTAT
 41  P  G  K  G  L  E  W  V  S  V  I  S  P  S  G  G  Q  T  G  Y 181 GCTGACTCCGTTAAAGGTCGCTTCACTATCTCTAGAGACAACTCTAAGAATACTCTCTAC
 61  A  D  S  V  K  G  R  F  T  I  S  R  D  N  S  K  N  T  L  Y 241 TTGCAGATGAACAGCTTAAGGGCTGAGGACACTGCAGTCTACTATTGTGCGGGTGGTGGC
 81  L  Q  M  N  S  L  R  A  E  D  T  A  V  Y  Y  C  A  G  G  G 301 TACGCAGCCTTTGACTACTGGGGCCAGGGAACCCTGGTCACCGTCTCAAGCGCCTCCACC
101  Y  A  A  F  D  Y  W  G  Q  G  T  L  V  T  V  S  S  A  S  T 361 AAGGGCCCATCGGTCTTCCCGCTAGCACCCTCCTCCAAGAGCACCTCTGGGGGCACAGCG
121  K  G  P  S  V  F  P  L  A  P  S  S  K  S  T  S  G  G  T  A

421 GCCCTCGGC
141  A  L  G

Translation of VL-PC6-Tie1-phagemid.TXT(1-308)
Universal code
Total amino acid number: 102; MW=11014
Max ORF: 1-306, 102 AA, MW=11014
  1 CAAGACATCCAGATGACCCAGTCTCCAGCCACCCTGTCTTTGTCTCCAGGGGAAAGAGCC     (SEQ ID NO: 29)
  1  Q  D  I  Q  M  T  Q  S  P  A  T  L  S  L  S  P  G  E  R  A     (SEQ ID NO: 30)

61 ACCCTCTCCTGCAGGGCCAGTCAGAGTGTTAGCAGCTACTTAGCCTGGTACCAACAGAAA
 21  T  L  S  C  R  A  S  Q  S  V  S  S  Y  L  A  W  Y  Q  Q  K

121 CCTGGCCAGGCTCCCAGGCTCCTCATCTATGATGCATCCAACAGGGCCACTGGCATCCCA
 41  P  G  Q  A  P  R  L  L  I  Y  D  A  S  N  R  A  T  G  I  P

181 CCCAGGTTCAGTGCCAGTGGGTCTGGGACAGACTTCACTCTCACCATCACCAGCCTAGAC
 61  A  R  F  S  G  S  G  S  G  T  D  F  T  L  T  I  S  S  L  E

241 CCTGAAGATTTTGCAGTTTATTACTGTCAGCAGCGTAGCAACTGGCCTCTCACTTTCGGC
 81  P  E  D  F  A  V  Y  Y  C  Q  Q  R  S  N  W  P  L  T  F  G

301 GCAGCGAC
101  G  G

Translation of Reverse_Complement_VH-PD6-Tie1-phagemid.TXT(1-396)
Universal code
Total amino acid number: 132, MW=14217
Max ORF: 1-396, 132 AA, MW=14217
  1 GAACTTCAATTGTTACAGTCTGGTGGCGCTCTTGTTCACCCTCGTGCTTCTTTACGTCTT     (SEQ ID NO: 31)
  1  E  V  Q  L  L  E  S  G  G  G  L  V  Q  P  G  G  S  L  R  L     (SEQ ID NO: 32)

61 TCTTCCGCTCCTTCCCGATTCACTTTCTCTGCTTACCGTATGCACTCGCTTCCCCAAGCT
 21  S  C  A  A  S  G  F  T  F  S  A  Y  R  M  E  W  V  R  Q  A

121 CCTGCTAAAGGTTTGGACTGGGTTCTTCTATCTATCCTTCTGCTGCCATTACTTATTAT
 41  P  G  K  G  L  E  W  V  S  S  I  Y  P  S  G  G  I  T  Y  Y

181 CCTCACTCCCTTAAACCTCCCTTCACTATCTCTACACACAACTCTAACAATACTCTCTAC
 61  A  D  S  V  K  G  R  F  T  I  S  R  D  N  S  K  N  T  L  Y

241 TTCCACATCAACACCTTAACCCCTCACCACACTCCACTCTACTATTCTCCCACACTCAAT
 81  L  Q  M  N  S  L  R  A  E  D  T  A  V  Y  Y  C  A  R  V  N

301 TACTATCATACTACTCCTTACCCTCCTATACCTCCTCCACTTCACTACTCCCCCCACCCA
101  Y  Y  D  S  S  G  Y  G  P  I  A  P  G  L  D  Y  W  G  Q  G

361 ACCCTCCTCACCCTCTCAACCCCCTCCACCAACCCC
121  T  L  V  T  V  S  S  A  S  T  K  G

Translation of VL-PD6-Tie1-phagemid.TXT(1-308)
Universal code
Total amino acid number: 101, MW=10731
Max ORF: 115-306, 64 AA, MW=6731
  1 CAACACATCCACATCACCCACTCTCCATCCTCCCTCTCTCCATCTCTACCACACACACTT     (SEQ ID NO: 33)
  1  Q  D  I  Q  M  T  Q  S  P  S  S  L  S  A  S  V  G  D  R  V     (SEQ ID NO: 34)

61 ACCATCACTTCCCCCCCAACTCACCCCATTACCACTTATTTACCCTCCTATTACCACAAA
 21  T  I  T  C  R  A  S  Q  G  I  T  T  Y  L  G  W  Y  *  Q  K

121 CCACCCAAACCCCCTAACCTCCTCATCTATCCTCCATCCACTTTCCAAACTCCCCTCCCA
 41  P  G  K  A  P  K  L  L  I  Y  A  A  S  T  L  Q  S  G  V  P

181 CCAAACTTCACCCCCACTCCATCTCCCACACTTTTCACTCTCACCATCACCCCTCTCCAA
 61  A  K  F  S  G  S  G  S  G  T  L  F  T  L  T  I  S  G  L  Q
```

```
                                        -continued
241 CCTCAACATTCTCCAACTTACTACTCTCACCACACTTACAATACCCCTTCCACCTTCGCC
 81  P   E   D   S   A   T   Y   Y   C   H   Q   S   Y   N   T   P   W   T   F   G

301 CAACCCAC
101  Q   G

Translation of VH-PD10-Tie1-phagemid.TXT(1-412)
Universal code
Total amino acid number: 136, MW=14313
Max ORF: 181-411, 77 AA, MW=8216
  1 GAAGTTCAATTGTTACAGTCTCGTCGCGCTCTTCTTCAGCCTGCTGCTTCTTTACGTCTT    (SEQ ID NO: 35)
  1  E   V   Q   L   L   E   S   G   G   G   L   V   Q   P   G   G   S   L   R   L    (SEQ ID NO: 36)

61 TCTTGCGCTGCTTCCCGATTCACTTTCTCTGGTTACGGTATCCATTGGGTTCGCCAACCT
 21  S   C   A   A   S   G   F   T   F   S   G   Y   G   M   H   W   V   R   Q   A

121 CCTGCTAAACGTTTGGACTGGCTTTCTGTTATCTCCTTCTGGTCGCACACTTGCTAG
 41  P   G   K   G   L   E   W   V   S   V   I   S   P   S   G   G   Q   T   W   *

181 GCTGACTCCGTTAAAGGTCGCTTCACTATCTCTAGAGACAACTCTAACAATACTCTCTAC
 61  A   D   S   V   K   G   R   F   T   I   S   R   D   N   S   K   N   T   L   Y

241 TTGCACATGAACACCTTAAGCGCTGAGCACACTGCAGTCTACTATTGTCCGAGAGGCGCC
 81  L   Q   M   N   S   L   R   A   E   D   T   A   V   Y   Y   C   A   R   G   G

301 ACCAGTAACCCACTGTTTTACTGGGGCCACGGAACCCTGGTCACCCTCTCAAGCCCCTCC
101  T   S   N   P   L   F   Y   W   G   Q   G   T   L   V   T   V   S   S   A   S

361 ACCAACCCCCCATCCCTCTTCCCCCTACCACCCTCCTCCAACACCACCTCTC
121  T   K   G   P   S   V   F   P   L   A   P   S   S   K   S   T   S

Translation of VL-PD10-Tie1-phagemid.TXT(1-308)
Universal code
Total amino acid number: 102, MW=11069
Max ORF: 1-306, 102 AA, MW=11069
  1 CAACACATCCACATCACCCACTCTCCACCCACCCTCTCTTTCTCTCCACCCCAAACACCC    (SEQ ID NO: 37)
  1  Q   D   I   Q   M   T   Q   S   P   A   T   L   S   L   S   P   G   E   R   A    (SEQ ID NO: 38)

61 ACCCTCTCCTCCACCCCCACTCACACTCTTACCACCTACTTACCCTCCTACCAACACAAA
 21  T   L   S   C   R   A   S   Q   S   V   S   S   Y   L   A   W   Y   Q   Q   K

121 CCTCCCCACCCTCCCACCCTC.CTCATCTATCATCCATCCAACACCCCCACTCCCATCCCA
 41  P   G   Q   A   P   R   L   L   I   Y   D   A   S   N   R   A   T   G   I   P

181 CCCACCTTCACTCCCACTCCCTCTCCCACACACTTCACTCTCACCATCACCACCCTACAC
 61  A   R   F   S   G   S   G   S   G   T   D   F   T   L   T   I   S   S   L   E

241 CCTCAACATTTTCCACTTTATTACTCTCACCACCCTACCAACTCCCCTCCCACTTTTCCC
 81  P   E   D   F   A   V   Y   Y   C   Q   Q   R   S   N   W   P   P   T   F   G

301 CACCCCAC
101  Q   G

Translation of VH-PD12-Tie1-phagemid.TXT(1-444)
Universal code
Total amino acid number: 148, MW=15535
Max ORF: 1-444, 148 AA, MW=15535
  1 GAAGTTCAATTGTTAGAGTCTGGTGGCGGTCTTGTTCAGCCTGGTGGTTCTTTACGTCTT    (SEQ ID NO: 39)
  1  E   V   Q   L   L   E   S   G   G   G   L   V   Q   P   G   G   S   L   R   L    (SEQ ID NO: 40)

61 TCTTGCGCTGCTTCCGGATTCACTTTCTCTGGTTACGGTATGCATTGGGTTCGCCAAGCT
 21  S   C   A   A   S   G   F   T   F   S   G   Y   G   M   H   W   V   R   Q   A

121 CCTGGTAAAGGTTTGGAGTGGGTTTCTGTTATCTCTCCTTCTGGTGGCCAGACTTCTTAT
 41  P   Q   K   G   L   E   W   V   S   V   I   S   P   S   G   G   Q   T   S   Y

181 GCTGACTCCGTTAAAGGTCGCTTCACTATCTCTAGAGACAACTCTAAGAATACTCTCTAC
 61  A   D   S   V   K   G   R   F   T   I   S   R   D   N   S   K   N   T   L   Y

241 TTGCAGATGAACAGCTTAAGGGCTGAGGACACTGCAGTCTACTATTGTGCGAGAGATAGG
 81  L   Q   M   N   S   L   R   A   E   D   T   A   V   Y   Y   C   A   R   D   R

301 CAGTATTACTATGGTTCGGGGAGTCTTGACTACTGGGGCCAGGGAACCCTGGTCACCGTC
101  Q   Y   Y   Y   G   S   G   S   L   D   Y   W   G   Q   G   T   L   V   T   V

361 TCAAGCGCCTCCACCAAGGGCCCATCGGTCTTCCCGCTAGCACCCTCCTCCAAGAGCACC
121  S   S   A   S   T   K   G   P   S   V   F   P   L   A   P   S   S   K   S   T

421 TCTGGGGGCACAGCGGCCCTGGGC
141  S   G   G   T   A   A   L   G
```

-continued

Translation of VL-PD12-Tie1-phagemid.TXT(1-308)
Universal code
Total amino acid number: 102, MW=11060
Max ORF: 1-306, 102 AA, MW=11060

```
1   CAAGACATCCAGATGACCCAGTCTCCATCCTCCCTGTCTGCATCTGTAGGAGACAGAGTC  (SEQ ID NO: 41)
1    Q  D  I  Q  M  T  Q  S  P  S  S  L  S  A  S  V  G  D  R  V  (SEQ ID NO: 42)

61  ACCGTCACTTGCCGGGCAAGTCAGAGCATTAGCAGTTATTTAAATTGGTATCAGCAGAAA
21   T  V  T  C  R  A  S  Q  S  I  S  S  Y  L  N  W  Y  Q  Q  K

121 CCAGGGAAAGCCCCTAAACTCCTGATCTATGCTGCATCCAGTTTGCAAAGTGGGGTCCCA
41   P  G  K  A  P  K  L  L  I  Y  A  A  S  S  L  Q  S  G  V  P

181 TCAAGGTTCAGTGGCGGTGGATCTGGGACAGATTTCACTCTCACCATCAGCAGTCTGCAA
61   S  R  F  S  G  G  G  S  G  T  D  F  T  L  T  I  S  S  L  Q

241 CCTGAAGATTTTGCAACTTATTTCTGTCTACAAGATTACAAATACCCGTGGACGTTCGGC
81   P  E  D  F  A  T  Y  F  C  L  Q  D  Y  K  Y  P  W  T  F  G

301 CAAGGGAC
101  Q  G
```

Translation of Reverse Complement_VH-PF3-Tie1-phagemid.TXT(1-375)
Universal code
Total amino acid number: 125, MW=13201
Max ORF: 1-375, 125 AA, MW=13201

```
1   GAAGTTCAATTGTTAGAGTCTGGTGGCGGTCTTGTTCAGCCTGGTGGTTCTTTACGTCTT  (SEQ ID NO: 43)
1    E  V  Q  L  L  E  S  G  G  G  L  V  Q  P  G  G  S  L  R  L  (SEQ ID NO: 44)

61  TCTTGCGCTGCTTCCGGATTCACTTTCTCTATGTACGGTATGGGTTGGGTTCGCCAAGCT
21   S  C  A  A  S  G  F  T  F  S  M  Y  G  M  G  W  V  R  Q  A

121 CCTGGTAAAGGTTTGGAGTGGGTTTCTGTTATCTCTCCTTCTGGTGGCCAGACTGCTTAT
41   P  G  K  G  L  E  W  V  S  V  I  S  P  S  G  G  Q  T  A  Y

181 GCTGACTCCGTTAAAGGTCGCTTCACTATCTCTAGAGACAACTCTAAGAATACTCTCTAC
61   A  D  S  V  K  G  R  F  T  I  S  R  D  N  S  K  N  T  L  Y

241 TTGCAGATGAACAGCTTAAGGGCTGAGGACACTGCAGTCTACTATTGTGCGAGAGTGGCC
81   L  Q  M  N  S  L  R  A  E  D  T  A  V  Y  Y  C  A  R  V  A

301 TTGCTCCTGGGCACGCTTTTGATATCTGGGGCCAAGGGACAATGGTCACCGTCTCAAGC
101  L  L  L  G  H  A  F  D  I  W  G  Q  G  T  M  V  T  V  S  S

361 GCCTCCACCAAGGGC
121  A  S  T  K  G
```

Translation of VL-PF3-Tie1-phagemid.TXT(1-308)
Universal code
Total amino acid number: 102, MW=11162
Max ORF: 1-306, 102 AA, MW=11162

```
1   CAAGACATCCAGATGACCCAGTCTCCTTCCACCCTGTCTGCATCTTTAGGAGACAGAGTC  (SEQ ID NO: 45)
1    Q  D  I  Q  M  T  Q  S  P  S  T  L  S  A  S  L  G  D  R  V  (SEQ ID NO: 46)

61  ACCATCACTTGCCGGGCCAGTCAGAGTATTAGTAGGTGGTTGGCCTGGTATCAGCAGAAA
21   T  I  T  C  R  A  S  E  S  I  S  R  W  L  A  W  Y  Q  Q  K

121 CCAGGGAAAGCCCCTAAGCTCCTGATGTATGAGGCATCCACTTTAGAAAGTGGGGTCCCA
41   P  G  K  A  P  K  L  L  M  Y  E  A  S  T  L  E  S  G  V  P

181 TCAAGGTTCACCGGCACTGGATCTGGGACAGAATTCACTCTCACCATCAGCAGCCTGCAG
61   S  R  F  T  G  T  G  S  G  T  E  F  T  L  T  I  S  S  L  Q

241 CCCGATGATTTTGCAACTTATTACTGTCAGCAGCGTAGCAACTGGCCCCTCACTTTCGGC
81   P  D  D  F  A  T  Y  Y  C  Q  Q  R  S  N  W  P  L  T  F  G

301 GGAGGGAC
101  G  G
```

Translation of VH-PF4-Tie1-phagemid.TXT(1-429)
Universal code
Total amino acid number: 143, MW=14996
Max ORF: 1-429, 143 AA, MW=14996

```
1   GAAGTTCAATTGTTAGAGTCTGGTGGCGGTCTTGTTCAGCCTGGTGGTTCTTTACGTCTT  (SEQ ID NO: 47)
1    E  V  Q  L  L  E  S  G  G  G  L  V  Q  P  G  G  S  L  R  L  (SEQ ID NO: 48)

61  TCTTGCGCTGCTTCCGGATTCACTTTCTCTGCTTACATGATGTCTTGGGTTCGCCAAGCT
21   S  C  A  A  S  G  F  T  F  S  A  Y  M  M  S  W  V  R  Q  A
```

```
                                                      -continued
121 CCTGGTAAAGGTTTGGAGTGGGTTTCTTCTATCTATCCTTCTGGTGGCTATACTTATTAT
 41  P  G  K  G  L  E  W  V  S  S  I  Y  P  S  G  G  Y  T  Y  Y 181 GCTGACTCCGTTAAACGTCGCTTCACTATCTCTAGAGACAACTCTAAGAATACTCTCTAC
 61  A  D  S  V  K  G  R  F  T  I  S  R  D  N  S  K  N  T  L  Y 241 TTGCAGATGAACAGCTTAAGGGCTGAGCACACTGCAGTCTACTATTGTGCGAGAGGCTTA
 81  L  Q  M  N  S  L  R  A  E  D  T  A  V  Y  Y  C  A  R  G  L 301 CCCGGAGGTCCTGACTACTGCGGCCAGGCAACCCTGCTCACCGTCTCAAGCGCCTCCACC
101  R  G  G  P  D  Y  W  G  Q  C  T  L  V  T  V  S  S  A  S  T 361 AAGGGCCCATCCGTCTTCCCGCTAGCACCCTCCTCCAAGACCACCTCTGGGCGCACAGCG
121  K  G  P  S  V  F  P  L  A  P  S  S  K  T  T  S  G  G  T  A

421 GCCCTCCCC
141  A  L  G
```

Translation of VL-PF4-Tie1-phagemid.TXT(1-308)
Universal code
Total amino acid number: 102, MW=10966
Max ORF: 1-306, 102 AA, MW=10966

```
  1 CAAGACATCCAGATGACCCACTCTCCTTCCACCCTGTCTGCATATGTAGGACACAGTGTC   (SEQ ID NO: 49)
  1  Q  D  I  Q  M  T  Q  S  P  S  T  L  S  A  Y  V  G  D  S  V   (SEQ ID NO: 50)

61 ACCATCACTTGCCGGCCCAGTCAGAGTGTGAGAAGGTCGTTGGCCTGGTATCAGCAGAGA
 21  T  I  T  C  R  A  S  Q  S  V  R  R  S  L  A  W  Y  Q  Q  R

121 CCAGGGAAAGCCCCCAAGTCCCTCATCTATAAGCCGTCTACTTTAGAGACTGGGGTCCCA
 41  P  G  K  A  P  K  S  L  I  Y  K  A  S  T  L  E  T  G  V  P

181 CCAAGGTTCACCGGCACTGCATCTGGCACAGAATTCACTCTCACCATCAGCAGCCTGCAG
 61  P  R  F  S  G  S  G  S  G  T  E  F  T  L  T  I  S  S  L  Q

241 CCTGAAGATTCTGCAATTTATTACTGCCAACAATATGGTAGTTTTCCGCTCACTTTCGGC
 81  P  E  D  S  A  I  Y  Y  C  Q  Q  Y  G  S  F  P  L  T  F  G

301 GCACCCAC
101  G  G
```

Translation of VH-PG3-Tie1-phagemid.TXT(1-441)
Universal code
Total amino acid number: 147, MW=15647
Max ORF: 1-441, 147 AA, MW=15647

```
  1 GAAGTTCAATTGTTAGAGTCTGGTGGCGGTCTTGTTCAGCCTGGTGGTTCTTTACGTCTT   (SEQ ID NO: 51)
  1  E  V  Q  L  L  E  S  G  G  G  L  V  Q  P  G  G  S  L  R  L   (SEQ ID NO: 52)

61 TCTTGCGCTGCTTCCGGATTCACTTTCTCTCATTACATGATGGTTTGGGTTCGCCAAGCT
 21  S  C  A  A  S  G  F  T  F  S  H  Y  M  M  V  W  Y  R  Q  A

121 CCTGGTAAAGGTTTGGAGTGGGTTTCTTCTATCTATCCTTCTGGTGGCTGGACTTATTAT
 41  P  G  K  G  L  E  W  V  S  S  I  Y  P  S  G  G  W  T  Y  Y

181 GCTGACTCCGTTAAAGGTCGCTTCACTATCTCTAGAGACAACTCTAAGAATACTCTCTAC
 61  A  D  S  V  K  G  R  F  T  I  S  R  D  N  S  K  N  T  L  Y

241 TTGCAGATGAACAGCTTAAGGGCTGAGGACACTGCAGTCTACTATTGTGCGAGGCTGGAC
 81  L  Q  M  N  S  L  R  A  E  D  T  A  V  Y  Y  C  A  R  L  D

301 TACGGTGGTAATTCCGCCTACTTTGACTACTGGGGCCAGGGAACCCTGGTCACCGTCTCA
101  Y  G  G  N  S  A  Y  F  D  Y  W  G  Q  G  T  L  V  T  V  S

361 AGCGCCTCCACCAAGGGCCCATCGGTCTTCCCGCTAGCACCCTCCTCCAAGAGCACCTCT
121  S  A  S  T  K  G  P  S  V  F  P  L  A  P  S  S  K  S  T  S

421 GGGGGCACAGCGGCCCTGGGC
141  G  G  T  A  A  L  G
```

Translation of VL-PG3-Tie1-phagemid.TXT(1-327)
Universal code
Total amino acid number: 109, MW=11792
Max ORF: 1-327, 109 AA, MW=11792

```
  1 CAGAGCGTCTTGACTCAGCCGCACTCTGTGTCGGCCTCTCCGGGGAAGACGGTAACCATC   (SEQ ID NO: 53)
  1  Q  S  V  L  T  Q  P  H  S  V  S  A  S  P  G  K  T  V  T  I   (SEQ ID NO: 54)

61 TCCTGCACCCGCAGCAGTGGCAACATTGCCAGCAACTTTGTCCAGTGGTACCAACAGCGC
 21  S  C  T  R  S  S  G  N  I  A  S  N  F  V  Q  W  Y  Q  Q  R

121 CCGGGCAGTGTCCCCACCACTGTGATTTATGAAGATGACCGAAGACCCTCTGGGGTCCCT
 41  P  G  S  V  P  T  T  V  I  Y  E  D  D  R  R  P  S  G  V  P
```

```
                          -continued
181 GATCGCTTTTCTGGCTCCATCGACAGTTCCTCCAACTCTGCTTTCCTCAGCATCTCTGGA
 61   D   R   F   S   G   S   I   D   S   S   S   N   S   A   F   L   S   I   S   G 241 CTGAAGACTGAGGACGAGGCAGACTATTACTGTCAGTCTCATGATCGTACCACCCGTGCT
 81   L   K   T   E   D   E   A   D   Y   Y   C   Q   S   H   D   R   T   T   R   A

301 TGGGTGTTCGGCGGAGGGACCAAGCTG
101   W   V   F   G   G   G   T   K   L

Translation of VH-SA2-Tie1-phagemid.TXT(1-413)
Universal code
Total amino acid number: 137, MW=14682
Max ORF: 1-411, 137 AA, MW=14682
  1 GAAGTTCAATTGTTAGAGTCTGGTGGCGGTCTTGTTCAGCCTGGTGGTTCTTTACGTCTT  (SEQ ID NO: 55)
  1   E   V   Q   L   L   E   S   G   G   G   L   V   Q   P   G   G   S   L   R   L  (SEQ ID NO: 56)

61 TCTTGCGCTGCTTCCGGATTCACTTTCTCTCGTTACACTATGATGTGGGTTCGCCAAGCT
 21   S   C   A   A   S   G   F   T   F   S   R   Y   T   M   M   W   V   R   Q   A

121 CCTGGTAAAGGTTTGGAGTGGGTTTCTGGTATCTATCCTTCTGGTGGCGTTACTCTTTAT
 41   P   G   K   G   L   E   W   V   S   G   I   Y   P   S   G   G   V   T   L   Y

181 GCTGACTCCGTTAAAGGTCGCTTCACTATCTCTAGAGACAACTCTAAGAATACTCTCTAC
 61   A   D   S   V   K   G   R   F   T   I   S   R   D   N   S   K   N   T   L   Y

241 TTGCAGATGAACAGCTTAAGGGCTGAGGACACTGCAGTCTACTATTGTGCGAGAGTCAAT
 81   L   Q   M   N   S   L   R   A   E   D   T   A   V   Y   Y   C   A   R   V   N

301 TACTATGATAGTAGTGGTTACGGTCCTATAGCTCCTGGACTTGACTACTGGGGCCAGGGA
101   Y   Y   D   S   S   G   Y   G   P   I   A   P   G   L   D   Y   W   G   Q   G

361 ACCCTGGTCACCGTCTCAAGCGCCTCCACCAAGGGCCCATCGGTCTTCCCGCT
121   T   L   V   T   V   S   S   A   S   T   K   G   P   S   V   F   P

Translation of VL-SA2-Tie1-phagemid.TXT(1-339)
Universal code
Total amino acid number:. 113, MW=12358
Max ORF: 1-339, 113 AA, MW=12358
  1 CACAGTGCACAAGACATCCAGATGACCCAGTCTCCAGGCACCCTGTCTTTGTCTCCAGGG  (SEQ ID NO: 57)
  1   H   S   A   Q   D   I   Q   M   T   Q   S   P   G   T   L   S   L   S   P   G  (SEQ ID NO: 58)

61 GAAAGAGCCACACTCTCCTGCAGGGCCAGTCGGAGTGTGATCATCAGCTACGTAGCCTGG
 21   E   R   A   T   L   S   C   R   A   S   R   S   V   I   I   S   Y   V   A   W

121 TACCAGCAGAAACCTGGCCAGGCTCCCAGGCTCCTCATCTATGGAGCGTCCACCAGGGCC
 41   Y   Q   Q   K   P   G   Q   A   P   R   L   L   I   Y   G   A   S   T   R   A

181 ACTGGCATCCCAGACAGGTTCAGTGGCAGTGGGTCTGGGACAGACTTCACTCTCACCATC
 61   T   G   I   P   D   R   F   S   G   S   G   S   G   T   D   F   T   L   T   I

241 AGCAGACTGGAGCCTGAAGACTTTGCAGTGTATTTCTGTCAGCTTTATGGTAGGTCACCA
 81   S   R   L   E   P   E   D   F   A   V   Y   F   C   Q   L   Y   G   R   S   P

301 CGGATCATCTTCGGCCAAGGGACACGACTGGAGATTAAA
101   R   I   I   F   G   Q   G   T   R   L   E   I   K

Translation of VH-SA10-Tie1-phagemid.TXT(1-369)
Universal code
Total amino acid number: 123, MW=13314
Max ORF: 1-369, 123 AA, MW=13314
  1 GAAGTTCAATTGTTAGAGTCTGGTGGCGGTCTTGTTCACCCTGCTGGTTCTTTACCTCTT  (SEQ ID NO: 59)
  1   E   V   Q   L   L   E   S   G   G   G   L   V   Q   P   G   G   S   L   R   L  (SEQ ID NO: 60)

61 TCTTGCGCTGCTTCCCCCATTCACTTTCTCTAATTACGTTATCGTTTGGGTTCGCCAAGCT
 21   S   C   A   A   S   G   F   T   F   S   N   Y   V   M   W   V   R   Q   A

121 CCTGCTAAACGTTTGGAGTCCGTTTCTCCTATCTATCCTTCTCGTCCCCATACTAAGTAT
 41   P   G   K   G   L   E   W   V   S   G   I   Y   P   S   G   G   H   T   K   Y

181 GCTGACTCCCTTAAAGGTCCCTTCACTATCTCTAGAGACAACTCTAAGAATACTCTCTAC
 61   A   D   S   V   K   G   R   F   T   I   S   R   D   N   S   K   N   T   L   Y

241 TTCCACATCAACACCTTAACCCCTCACCACACTCCACTCTACTATTCTCCCACACTCAAT
 81   L   Q   M   N   S   L   R   A   E   D   T   A   V   Y   Y   C   A   R   V   N

301 TACTATCATACTACTCCTTACCCTCCTATACCTCCTCCACTTCACTACTCCCCCCACCCA
101   Y   Y   D   S   S   G   Y   G   P   I   A   P   G   L   D   Y   W   G   Q   G

361 ACCCTCCTC
121   T   L   V
```

-continued
Translation of VL-SA10-Tie1-phagemid.TXT(1-339)
Universal code
Total amino acid number: 113, MW=12445
Max ORF: 1-339, 113 AA, MW=12445

```
1   CACACTCCACAACACATCCACATCACCCACTCTCCACCCACCCTCTCTTTCTCTCCACCC  (SEQ ID NO: 61)
1    H  S  A  Q  D  I  Q  M  T  Q  S  P  G  T  L  S  L  S  P  G   (SEQ ID NO: 62)

61  CAAACACCCACCCTCTTCTCCACCCCCACTCACCCTCTTACCACCAACTCCTTCCCCTCC
21   E  R  A  T  L  F  G  R  A  S  Q  R  V  T  S  N  S  L  A  W

121 TACCACCACACACCTCCCCACCCTCCCACCCTCCTCATCTATCATCCATCCACCACCCCC
41   Y  Q  Q  R  P  G  Q  A  P  R  L  L  I  Y  D  A  S  T  R  A

181 ACTCCCATCCCACACCCCTTCACTCCCACTCCCTCCCCCACCCACTTCACTCTCACCATC
61   T  G  I  P  D  R  F  S  G  S  G  S  G  R  D  F  T  L  T  I

241 ACCACACTCCACCCTCAACATTTTCCACTTTATTACTCTCACCCATATCCTACTTCACTC
81   S  R  L  E  P  E  D  F  A  V  Y  Y  C  Q  R  Y  G  S  S  V

301 TTCTACTCTTTTCCCCACCCCACCAACTTCCAAATCACA
101  L  Y  S  F  G  Q  G  T  K  L  E  I  T
```

Translation of VH-SB2-Tie1-phagemid.TXT(1-383)
Universal code
Total amino acid number: 127, MW=13611
Max ORF: 1-381, 127 AA, MW=13611

```
1   GAAGTTCAATTGTTAGAGTCTGGTGGCGGTCTTGTTCAGCCTGGTGGTTCTTTACGTCTT  (SEQ ID NO: 63)
1    E  V  Q  L  L  E  S  G  G  G  L  V  Q  P  G  G  S  L  R  L   (SEQ ID NO: 64)

61  TCTTGCGCTGCTTCCGGATTCACTTTCTCTATTTACGGTATGGCTTGGGTTCGCCAAGCT
21   S  C  A  A  S  G  F  T  F  S  I  Y  G  M  A  W  V  R  Q  A

121 CCTGGTAAAGGTTTGGAGTGGGTTTCTGTTATCTCTCCTTCTGGTGGCCAGACTTTTTAT
41   P  G  K  G  L  E  W  V  S  V  I  S  P  S  G  G  Q  T  F  Y

181 GCTGACTCCGTTAAAGGTCGCTTCACTATCTCTAGAGACAACTCTAAGAATACTCTCTAC
61   A  D  S  V  K  G  R  F  T  I  S  R  D  N  S  K  N  T  L  Y

241 TTGCAGATGAACAGCTTAAGGGCTGAGGACACTGCAGTCTACTATTGTGCGAGAGTTTAC
81   L  Q  M  N  S  L  R  A  E  D  T  A  V  Y  Y  C  A  R  V  Y

301 TACTACGGTATGGACGTCTGGGGCCAAGGGACCACGGTCACCGTCTCAAGCGCCTCCACC
101  Y  Y  G  M  D  V  W  G  Q  G  T  T  V  T  V  S  S  A  S  T

361 AAGGGCCCATCGGTCTTCCCGCT
121  K  G  P  S  V  F  P
```

Translation of VL-SB2-Tie1-phagemid.TXT(1-333)
Universal code
Total amino acid number: 111, MW=12221
Max ORF: 1-333, 111 AA, MW=12221

```
1   CACACTGCACAAGACATCCAGATGACCCACTCTCCAGCCACCCTGTCTTTGTCTCCACGG  (SEQ ID NO: 65)
1    H  S  A  Q  D  I  Q  M  T  Q  S  P  A  T  L  S  L  S  P  G   (SEQ ID NO: 66)

61  GAAAGAGCCACCCTCTCCTGCAGGGCCAGTCAGAGTGTTAGCAGCTACTTAGCCTGGTAC
21   E  R  A  T  L  S  C  R  A  S  Q  S  V  S  S  Y  L  A  W  Y

121 CAACAAAAACCTGGCCAGGCTCCCAGGCTCCTCATTTATGATGCATCCAACAGGGCCACT
41   Q  Q  K  P  G  Q  A  P  R  L  L  I  Y  D  A  S  N  R  A  T

181 GGCATCCCAGCCAGGTTCAGTGGCAGTGGGTCTGAGACAGACTTCACTCTCACCATCAGC
61   G  I  P  A  R  F  S  G  S  G  S  E  T  D  F  T  L  T  I  S

241 AGCCTAGAGCCTGAAGATTTTGCAGTTTATTACTGTCAGCAGCGTAGCAAGTGGCCTCGG
81   S  L  E  P  E  D  F  A  V  Y  Y  C  Q  Q  R  S  K  W  P  R

301 ACTTTTGGCCAGGGGACCAAGCTGGAGATCAAA
101  T  F  G  Q  G  T  K  L  E  I  K
```

Translation of VH-SB9-Tie1-phagemid.TXT(1-413)
Universal code
Total amino acid number: 137, MW=14778
Max ORF: 1-411, 137 AA, MW=14778

```
1   GAAGTTCAATTGTTAGAGTCTGGTGGCGGTCTTGTTCAGCCTGGTGGTTCTTTACGTCTT  (SEQ ID NO: 67)
1    E  V  Q  L  L  E  S  G  G  G  L  V  Q  P  G  G  S  L  R  L   (SEQ ID NO: 68)

61  TCTTGCGCTGCTTCCGGATTCACTTTCTCTTCTTACGTTATGATGTGGGTTCGCCAAGCT
21   S  C  A  A  S  G  F  T  F  S  S  Y  V  M  M  W  V  R  Q  A
```

-continued

```
121 CCTGGTAAAGGTTTGGAGTGGGTTTCTGGTATCTATCCTTCTGGTGGCTGGACTTATTAT
 41  P  G  K  G  L  E  W  V  S  G  I  Y  P  S  G  G  W  T  Y  Y

181 ACTGACTCCGTTAAAGGTCGCTTCACTATCTCTAGAGACAACTCTAAGAATACTCTCTAC
 61  T  D  S  V  K  G  R  F  T  I  S  R  D  N  S  K  N  T  L  Y

241 TTGCAGATGAACAGCTTAAGGGCTGAGGACACTGCAGTCTACTATTGTGCGAGAGTCAAT
 81  L  Q  M  N  S  L  R  A  E  D  T  A  V  Y  Y  C  A  R  V  N

301 TAGTATGATAGTAGTGGTTACGGTCCTATAGGTCCTGGACTTGACTAGTGGGGGGAGGGA
101  Y  Y  D  S  S  G  Y  G  P  I  A  P  G  L  D  Y  W  G  Q  G

361 ACCCTGGTCAGCGTCTGAAGGGGTGCAGCAAGGGCCCATCGGTGTTGCCGCT
121  T  L  V  T  V  S  S  A  S  T  K  G  P  S  V  F  P
```

Translation of VL-SB9-Tie1-phagemid.TXT(1-336)
Universal code
Total amino acid number: 112, MW=12010
Max ORF: 1-336, 112 AA, MW=12010

```
  1 GACAGTGGAGAAGACATCCAGATGACCGAGTCTCGATGCTCGCTGTGTGCATCTGTTGGA  (SEQ ID NO: 69)
  1  H  S  A  Q  D  I  Q  M  T  Q  S  P  S  S  L  S  A  S  V  G  (SEQ ID NO: 70)

61 GATAGAGTGAGCATCAGTTGCGGGGGAAGTCAGAGTGTGAGCAGTGATTTAAGTTGGTTT
 21  D  R  V  T  I  T  G  R  A  S  Q  S  V  S  S  H  L  S  W  F

121 CAGCAGAGAGGAGGGAAAGGCGGAAGGTCGTGATCTATGATGGATGGAGTTTGCAAAGT
 41  Q  Q  R  P  G  K  A  P  N  L  L  I  Y  H  A  S  S  L  Q  S

181 GGGGTCCGATCAAGGTTCAGTGGCAGTGGGTCTGGGACAGATTTGACGCTCACGATCAGC
 61  G  V  P  S  R  F  S  G  S  G  S  G  T  D  F  T  L  T  I  S

241 AGTCTGCAACCTGAAGATTTTGGAACTTACTAGTGTCAGCAGAGTTACGGTAGTTCCTGG
 81  S  L  Q  P  E  D  F  A  T  Y  Y  C  Q  Q  S  Y  A  T  S  S

301 ATCACCTTCGGGCAGGGGAGACGAGTGGACATTAAA
101  I  T  F  G  Q  G  T  R  L  D  I  K
```

Translation of VH-SC2-Tie1-phagemid.TXT(1-413)
Universal code
Total amino acid number: 137, MW=14650
Max ORF: 1-411, 137 AA, MW=14650

```
  1 GAAGTTCAATTGTTAGAGTCTGGTGGCGGTCTTGTTCAGCCTGGTGGTTCTTTACGTCTT  (SEQ ID NO: 71)
  1  E  V  Q  L  L  E  S  G  G  G  L  V  Q  P  G  G  S  L  R  L  (SEQ ID NO: 72)

61 TCTTGCGCTGCTTCCGGATTCACTTTCTCTCGTTACAAGATGAAGTGGGTTCGCCAAGCT
 21  S  C  A  A  S  G  F  T  F  S  R  Y  K  M  K  W  V  R  Q  A

121 CCTGGTAAAGGTTTGGAGTGGGTTTCTGTTATCTATCCTTCTGGTGGCGGTACTGGTTAT
 41  P  G  K  G  L  E  W  V  S  V  I  Y  P  S  G  G  G  T  G  Y

181 GCTGACTCCGTTAAAGGTCGCTTCACTATCTCTAGAGACAACTCTAAGAATACTCTCTAC
 61  A  D  S  V  K  G  R  F  T  I  S  R  D  N  S  K  N  T  L  Y

241 TTGCAGATGAACAGCTTAAGGGCTGAGGACACTGCAGTCTACTATTGTGCGAGAGTCAAT
 81  L  Q  M  N  S  L  R  A  E  D  T  A  V  Y  Y  C  A  R  V  N

301 TACTATGATAGTAGTGGTTACGGTCCTATAGCTCCTGGACTTGACTACTGGGGCCAGGGA
101  Y  Y  D  S  S  G  Y  G  P  I  A  P  G  L  D  Y  W  G  Q  G

361 ACCCTGGTCACCGTCTCAAGCGCCTCCACCAAGGGCCCATCGGTCTTCCCGCT
121  T  L  V  T  V  S  S  A  S  T  K  G  P  S  V  F  P
```

Translation of VL-SC2-Tie1-phagemid.TXT(1-428)
Universal code
Total amino acid number: 142, MW=15044
Max ORF: 1-426, 142 AA, MW=15044

```
  1 CACAGTGCACAGAGCGTCTTGACTCAGCCTGACTCCGTGTCTGGGTCTCCTGGAGAGTCG  (SEQ ID NO: 73)
  1  H  S  A  Q  S  V  L  T  Q  P  D  S  V  S  G  S  P  G  E  S  (SEQ ID NO: 74)

61 ATCACCATCTCCTGCACTGGAAGCAGCAGAGACGTTGGTGGTTATAACTATGTCTCCTGG
 21  I  T  I  S  C  T  G  S  S  R  D  V  G  G  Y  N  Y  V  S  W

121 TACCAACAACACCCAGGCAAAGCCCCCAAACTCTTGCTTTATGATGTCACTTATCGGCCC
 41  Y  Q  Q  H  P  G  K  A  P  K  L  L  L  Y  D  V  T  Y  R  P

181 TCAGGGATTTCTGGTCGCTTCTCTGGCTCCAAGTCTGGCGACACGGCCTCCCTGACCATC
 61  S  G  I  S  G  R  F  S  G  S  K  S  G  D  T  A  S  L  T  I

241 TCTGGGCTCCGGACTGAGGACGAGGCTGATTATTACTGCAGCTCATCTATAGGCACCAGG
 81  S  G  L  R  T  E  D  E  A  D  Y  Y  C  S  S  S  I  G  T  R
```

```
301 ACTTATGTCTTCGGAAGTGGGACCAAGGTCACCGTCCTACGTCAGCCCAAGGCCAACCCC
101  T  Y  V  F  G  S  G  T  K  V  T  V  L  R  Q  P  K  A  N  P

361 ACTGTCACTCTGTTCCCGCCCTCCTCTGAGGAGCTCCAAGCCAACAAGGCCACACTAGTG
121  T  V  T  L  F  P  P  S  S  E  E  L  Q  A  N  K  A  T  L  V

421 TGTCTGAT
141  C  L

Translation of VH-SC7-Tie1-phagemid.TXT(1-386)
Universal code
Total amino acid number: 128, MW=13785
Max ORF: 1-384, 128 AA, MW=13785
1   GAAGTTCAATTGTTAGAGTCTGGTGGCGGTCTTGTTCAGCCTGGTGGTTCTTTACGTCTT  (SEQ ID NO: 75)
1    E  V  Q  L  L  E  S  G  G  G  L  V  Q  P  G  G  S  L  R  L  (SEQ ID NO: 76)

61  TCTTGCGCTGCTTCCGGATTCACTTTCTCTCGTTACGTTATGTATTGGGTTCGCCAAGCT
21   S  C  A  A  S  G  F  T  F  S  R  Y  V  M  Y  W  V  R  Q  A

121 CCTGGTAAAGGTTTGGAGTGGGTTTCTGTTATCTATCCTTCTGGTGGCGCTACTTATTAT
41   P  G  K  G  L  E  W  V  S  V  I  Y  P  S  G  G  A  T  Y  Y

181 GCTGACTCCGTTAAAGGTCGCTTCACTATCTCTAGAGACAACTCTAAGAATACTCTCTAC
61   A  D  S  V  K  G  R  F  T  I  S  R  D  N  S  K  N  T  L  Y

241 TTGCAGATGAACAGCTTAAGGGCTGAGGACACTGCAGTCTACTATTGTGCGAGACGGGGA
81   L  Q  M  N  S  L  R  A  E  D  T  A  V  Y  Y  C  A  R  R  G

301 AGTAGTGGTGCGTTTGACTACTGGGGCCAGGGAACCCTGGTCACCGTCTCAAGCGCCTCC
101  S  S  G  A  F  D  Y  W  G  Q  G  T  L  V  T  V  S  S  A  S

361 ACCAAGGGCCCATCGGTCTTCCCGCT
121  T  K  G  P  S  V  F  P

Translation of VL-SC7-Tie1-phagemid.TXT(1-434)
Universal code
Total amino acid number: 144, MW=15027
Max ORF: 1-432, 144 AA, MW=15027
1   CACAGTGCACAGAGCGTCTTGACTCAGCCTGCCTCCGTGTCTGGGTCTCCTGGACAGTCG  (SEQ ID NO: 77)
1    H  S  A  Q  S  V  L  T  Q  P  A  S  V  S  G  S  P  G  Q  S  (SEQ ID NO: 78)

61  ATCACCATCTCCTGCACTGGAACCAGCAGTGACATTGGTCGTTATAACTATGCCTCCTGG
21   I  T  I  S  C  T  G  T  S  S  D  I  G  R  Y  N  Y  A  S  W

121 TACCAACAACGCCCAGGCAAATCCCCCAAACTCCTGATTTATGAGGTCAGTGATCGGCCC
41   Y  Q  Q  R  P  G  K  S  P  K  L  L  I  Y  E  V  S  D  R  P

181 TCAGGGGTTTCTAATCGCTTCTCTGGCTCCAAGTCTGGCAACACGGCCTCCCTGATCATC
61   S  G  V  S  N  R  F  S  G  S  K  S  G  N  T  A  S  L  I  I

241 TCTGGGCTCCAGGCTGAGGACGAGGCTGATTATTACTGCAGCTCATATTCAAGCACCAAC
81   S  G  L  Q  A  E  D  E  A  D  Y  Y  C  S  S  Y  S  S  T  N

301 AGTCTCCAAGTGGTATTCGGCGGAGGGACCAAGCTGAGCGTCCTAGGTCAGCCCAAGGCT
101  S  L  Q  V  V  F  G  G  G  T  K  L  S  V  L  G  Q  P  K  A

361 GCCCCCTCGGTCACTCTGTTCCCGCCCTCCTCTGAGGAGCTTCAAGCCAACAAGGCCACA
121  A  P  S  V  T  L  F  P  P  S  S  E  E  L  Q  A  N  K  A  T

421 CTGGTGTGTCTCAT
141  L  V  C  L

Translation of VH-SC10-Tie1-phagemid.TXT(1-413)
Universal code
Total amino acid number: 137, MW=14688
Max ORF: 1-411, 137 AA, MW=14688
1   GAAGTTCAATTGTTAGAGTCTGGTGGCGGTCTTGTTCAGCCTGGTGGTTCTTTACGTCTT  (SEQ ID NO: 79)
1    E  V  Q  L  L  E  S  G  G  G  L  V  Q  P  G  G  S  L  R  L  (SEQ ID NO: 80)

61  TCTTGCGCTGCTTCCGGATTCACTTTCTCTGCTTACGGTATGTCTTGGGTTCGCCAAGCT
21   S  C  A  A  S  G  F  T  F  S  A  Y  G  M  S  W  V  R  Q  A

121 CCTGGTAAAGGTTTGGAGTGGGTTTCTGTTATCTATCCTTCTGGTGGCTGGACTTATTAT
41   P  G  K  G  L  E  W  V  S  V  I  Y  P  S  G  G  W  T  Y  Y

181 GCTGACTCCGTTAAAGGTCGCTTCACTATCTCTAGAGACAACTCTAAGAATACTCTCTAC
61   A  D  S  V  K  G  R  F  T  I  S  R  D  N  S  K  N  T  L  Y

241 TTGCAGATCAACAGCTTAAGGGCTGACCACACTGCAGTCTACTATTGTGCGAGAGTCAAT
81   L  Q  M  N  S  L  R  A  E  D  T  A  V  Y  Y  C  A  R  V  N
```

```
                                      -continued
301 TACTATGATAGTAGTGGTTACGGTCCTATAGCTCCTGGACTTGACTACTGGGGCCAGGGA
101  Y  Y  D  S  S  G  Y  G  P  I  A  P  G  L  D  Y  W  G  Q  G 361 ACCCTGGTCACCGTCTCAAGCGCCTCCACCAAGGCCCCATCGGTCTTCCCGCT
121  T  L  V  T  V  S  S  A  S  T  K  G  P  S  V  F  P
```

Translation of VL-SC10-Tie1-phagemid.TXT(1-336)
Universal code
Total amino acid number: 112, MW=12256
Max ORF: 1-336, 112 AA, MW=12256

```
1   CACACTGCACAAGACATCCAGATGACACAGTCTCCAGGCACCCTGTCTTTGTCTCCAGGG   (SEQ ID NO: 81)
1    H  S  A  Q  D  I  Q  M  T  Q  S  P  G  T  L  S  L  S  P  G   (SEQ ID NO: 82)

61  GAAAGAGCCACCCTCTCCTGCAGGCCCAGTCAGAGTGTTAGCAGCAGCTACTTAGCCTGG
21   E  R  A  T  L  S  C  R  A  S  Q  S  V  S  S  S  Y  L  A  W

121 TACCAGCAGAAACCTGCCCAGGCTCCCAGGCTCCTCATCTATGCTGCATCCAGCAGGCCC
41   Y  Q  Q  K  P  G  Q  A  P  R  L  L  I  Y  G  A  S  S  R  A

181 ACTGGCATCCCAGACAGGTTCAGTGGCAGTGGGTCTGCGACAGACTTCACTCTCACCATC
61   T  G  I  P  D  R  F  S  G  S  G  S  A  T  D  F  T  L  T  I

241 ACCAGACTGGAGCCTCAAGATTTTGCACTCTATTACTGTCAGCAGTATAATAACTGGCCT
81   S  R  L  E  P  E  D  F  A  V  Y  Y  C  Q  Q  Y  N  N  W  P

301 CGCACGTTCGGCCAAGGGACCAAGGTGGAAATCAAA
101  R  T  F  G  Q  G  T  K  V  E  I  K
```

Translation of VH-SD11-Tie1-phagemid.TXT(1-395)
Universal code
Total amino acid number: 131, MW=14005
Max ORF: 1-393, 131 AA, MW=14005

```
1   GAAGTTCAATTGTTAGAGTCTGGTGGCGGTCTTGTTCAGCCTGGTGGTTCTTTACGTCTT   (SEQ ID NO: 83)
1    E  V  Q  L  L  E  S  G  G  G  L  V  Q  P  G  G  S  L  R  L   (SEQ ID NO: 84)

61  TCTTGCGCTGCTTCCGGATTCACTTTCTCTGGTTACGCTATGTGGTGGGTTCGCCAAGCT
21   S  C  A  A  S  G  F  T  F  S  G  Y  A  M  W  W  V  R  Q  A

121 CCTGGTAAAGGTTTGGAGTGGGTTTCTTCTATCTCTCCTTCTGGTGGCGCTACTGCTTAT
41   P  G  K  G  L  E  W  V  S  S  I  S  P  S  G  G  A  T  A  Y

181 GCTGACTCCGTTAAAGGTCGCTTCACTATCTCTAGAGACAACTCTAAGAATACTCTCTAC
61   A  D  S  V  K  G  R  F  T  I  S  R  D  N  S  K  N  T  L  Y

241 TTGCAGATGAACAGCTTAAGGGCTGAGGACACTGCAGTCTACTATTGTGCGAGAGATGCG
81   L  Q  M  N  S  L  R  A  E  D  T  A  V  Y  Y  C  A  R  D  A

301 GGGAGTTATTATTGGGGCTGGTTCGACCCCTGGGGCCAGGGAACCCTGGTCACCGTCTCA
101  G  S  Y  Y  W  G  W  F  D  P  W  G  Q  G  T  L  V  T  V  S

361 AGCGCCTCCACCAAGGGCCCATCGGTCTTCCCGCT
121  S  A  S  T  K  G  P  S  V  F  P
```

Translation of VL-SD11-Tie1-phagemid.TXT(1-333)
Universal code
Total amino acid number: 111, MW=12194
Max ORF: 1-333, 111 AA, MW=12194

```
1   CACAGTGCACAAGACATCCAGATGACCCAGTCTCCAGCCACCTTGTCTTTGTCTCCAGGG   (SEQ ID NO: 85)
1    H  S  A  Q  D  I  Q  M  T  Q  S  P  A  T  L  S  L  S  P  G   (SEQ ID NO: 86)

61  GAAAGAGCCACCCTCTCCTGCAGGGCCAGTCAGAGTATTAGCAGCTACTTAGCCTGGTAC
21   E  R  A  T  L  S  C  R  A  S  Q  S  I  S  S  Y  L  A  W  Y

121 CAACAGAAACCTGGCCAGCCTCCCAGGCTCCTCATCTATGATGCATCCAGCAGGGTTACT
41   Q  Q  K  P  G  Q  P  P  R  L  L  I  Y  D  A  S  S  R  V  T

181 GGCATCCCAGCCAGGTTCAGTGGCAGTGGCTTTGGGACAGACTTCACTCTCACCATTAGT
61   G  I  P  A  R  F  S  G  S  G  F  G  T  D  F  T  L  T  I  S

241 AGCCTGGAGCCTGAAGATTTTGCAGTTTATTACTGTCTCCAGCGTAGCAGCTGGCCCCGA
81   S  L  E  P  E  D  F  A  V  Y  Y  C  L  Q  R  S  S  W  P  R

301 ACTTTTGGCCAGGGGACCAAGCTGGAGATCAAA
101  T  F  G  Q  G  T  K  L  E  I  K
```

-continued

Translation of VH-SE11-Tie1-phagemid.TXT(1-413)
Universal code
Total amino acid number: 137, MW=14670
Max ORF: 1-411, 137 AA, MW=14670

```
1   GAAGTTCAATTGTTAGAGTCTGGTGGCGGTCTTGTTCAGCCTGGTGGTTCTTTACGTCTT  (SEQ ID NO: 87)
1   E  V  Q  L  L  E  S  G  G  G  L  V  Q  P  G  G  S  L  R  L    (SEQ ID NO: 88)

61  TCTTGCGCTGCTTCCCGATTCACTTTCTCTGGTTACCTTATGTTTTGGGTTCCCCAAGCT
21  S  C  A  A  S  G  F  T  F  S  G  Y  V  M  F  W  V  R  Q  A

121 CCTGCTAAAGGTTTGGACTCGGTTTCTGGTATCTATCCTTCTCGTGCCTGGACTGTTTAT
41  P  G  K  G  L  E  W  V  S  G  I  Y  P  S  G  G  W  T  V  Y

181 GCTCACTCCGTTAAAGCTCGCTTCACTATCTCTAGAGACAACTCTAAGAATACTCTCTAC
61  A  D  S  V  K  G  R  F  T  I  S  R  D  N  S  K  N  T  L  Y

241 TTGCACATGAACAGCTTAAGGGCTCACCACACTCCAGTCTACTATTCTCCGAGAGTCAAT
81  L  Q  M  N  S  L  R  A  E  D  T  A  V  Y  Y  C  A  R  V  N

301 TACTATGATAGTAGTGCTTACGGTCCTATAGCTCCTGCACTTCACTACTGGCGCCAGGGA
101 Y  Y  D  S  S  G  Y  G  P  I  A  P  G  L  D  Y  W  G  Q  G

361 ACCCTGGTCACCGTCTCAACCCCCTCCACCAAGGGCCCATCGGTCTTCCCCCT
121 T  L  V  T  V  S  S  A  S  T  K  G  P  S  V  F  P
```

Translation of VL-SD11-Tie1-phagemid.TXT(1-333)
Universal code
Total amino acid number: 111, MW=11962
Max ORF: 1-333, 111 AA, MW=11962

```
1   CACACTGCACAACACATCCAGATCACCCACTCTCCACGCACCCTGTCTTTGTCTCCACGG  (SEQ ID NO: 89)
1   H  S  A  Q  D  I  Q  M  T  Q  S  P  G  T  L  S  L  S  P  G    (SEQ ID NO: 90)

61  GAAAGAGCCACCCTCTCCTCCAGGGCCACTCAGAGTCTTAGCAGCACCTACTTACCCTCG
21  E  R  A  T  L  S  C  R  A  S  Q  S  V  S  S  S  Y  L  A  W

121 TACCAGCAGAAACCTGGCCAGGCTCCCAGGCTCCTCATCTATGGTGCATCCAGCAGGCCC
41  Y  Q  Q  K  P  G  Q  A  P  R  L  L  I  Y  C  A  S  S  R  A

181 ACTCGCATCCCAGACAGGTTCAGTCCCAGTCCCTCTGCCACACACTTCACTCTCACCATC
61  T  G  I  P  D  R  F  S  G  S  G  S  T  D  F  T  L  T  I

241 AGCAGACTGGAGCCTGAAGATTTTGCAGTCTATTACTGTCAGCAATATGGTAGCTCACGG
81  S  R  L  E  P  E  D  F  A  V  Y  Y  C  Q  Q  Y  G  S  S  R

301 ACGTTCCCCCAAGGGACCAACGTGGAAATCAAA
101 T  F  G  Q  G  T  N  V  E  I  K
```

Translation of VH-SG4-Tie1-phagemid.TXT(1-395)
Universal code
Total amino acid number: 131, MW=14168
Max ORF: 1-393, 131 AA, MW=14168

```
1   GAAGTTCAATTGTTAGAGTCTGGTGGCGGTCTTGTTCAGCCTGGTGGTTCTTTACGTCTT  (SEQ ID NO: 91)
1   E  V  Q  L  L  E  S  G  G  G  L  V  Q  P  G  G  S  L  R  L    (SEQ ID NO: 92)

61  TCTTGCGCTGCTTCCGGATTCACTTTCTCTTCTTACATGATGACTTGGGTTCGCCAAGCT
21  S  C  A  A  S  G  F  T  F  S  S  Y  M  M  T  W  V  R  Q  A

121 CCTGGTAAAGGTTTGGAGTGGGTTTCTTCTATCTATCCTTCTGGTGGCTATACTTATTAT
41  P  G  K  G  L  E  W  V  S  S  I  Y  P  S  G  G  Y  T  Y  Y

181 GCTGACTCCGTTAAAGGTCGCTTCACTATCTCTAGAGACAACTCTAAGAATACTCTCTAC
61  A  D  S  V  K  G  R  F  T  I  S  R  D  N  S  K  N  T  L  Y

241 TTGCAGATGAACAGCTTAAGGGCTGAGGACACTGCAGTCTACTATTGTGCGAGAGGAGGG
81  L  Q  M  N  S  L  R  A  E  D  T  A  V  Y  Y  C  A  R  G  G

301 TATGGCGACTCGTCATTTTTTTTTGACTACTGGGGCCAGGGAACCCTGGTCACCGTCTCA
101 Y  G  D  S  S  F  F  F  D  Y  W  G  Q  G  T  L  V  T  V  S

361 AGCGCCTCCACCAAGGGCCCATCGGTCTTCCCGCT
121 S  A  S  T  K  G  P  S  V  F  P
```

-continued

```
Translation of VL-SG4-Tie1-phagemid.TXT(1-333)
Universal code
Total amino acid number: 111, MW=11832
Max ORF: 1-333, 111 AA, MW=11832
1   CACAGTGCACAAGACATCCAGATGACCCAGTCTCCAGCCACCCTGTCTGTGTCTCCAGGG     (SEQ ID NO: 93)
1    H  S  A  Q  D  I  Q  M  T  Q  S  P  A  T  L  S  V  S  P  G    (SEQ ID NO: 94)

61  GAAGGAGCCACCCTCTCTTGCAGGGCCAGTCGGAGTGTTGGCAGCAACTTAGCCTGGTAC
21   E  G  A  T  L  S  C  R  A  S  R  S  V  G  S  N  L  A  W  Y

121 CAGCAGAAGCCTGGCCAGGCTCCCAGGCTCCTCATCTATGATGCATCCACCAGGGCCACT
41   Q  Q  K  P  G  Q  A  P  R  L  L  I  Y  D  A  S  T  R  A  T

181 GGTATCCCCGCCAGGTTCAGTGGCAGTGGGTCTGGGACAAAGTTCACTCTCACCATCAGC
61   G  I  P  A  R  F  S  G  S  G  S  G  T  K  F  T  L  T  I  S

241 AGCCTCCAGTCTGAAGATTTTGCAGTTTATTACTGTCAGCAGCGTAGCAATTGGCCTCTC
81   S  L  Q  S  E  D  F  A  V  Y  Y  C  Q  Q  R  S  N  W  P  L

301 ACTTTCGGCGGAGGGACCAAGGTGGAGATCAAA
101  T  F  G  G  G  T  K  V  E  I  K
```

20

Complete sequence VH-SG9 not known

```
Translation of VL-SG9-Tie1-phagemid.TXT(1-428)
Universal code
Total amino acid number: 142, MW=14993
Max ORF: 1-426, 142 AA, MW=14993
1   CACAGTGCACAGAGCGTCTTGACTCAGCCTGCCTCCGTGTCTGGGTCTCCTGGACAGTCG     (SEQ ID NO: 95)
1    H  S  A  Q  S  V  L  T  Q  P  A  S  V  S  G  S  P  G  Q  S    (SEQ ID NO: 96)

61  ATCACCATCTCCTGCACTCGAACCAGCAGTGACGTTGGTGATGATAACTATGTCTCCTGG
21   I  T  I  S  C  T  G  T  S  S  D  V  G  D  D  N  Y  V  S  W

121 TACCAACAACACCCACACAAACCCCCCAAACTCATGATTTATCACCTCACTTATCCCCCC
41   Y  Q  Q  H  P  D  K  A  P  K  L  M  I  Y  E  V  S  Y  R  P

181 TCAGGGGTTTCTAATCGCTTCTCTCGCTCCAAGTCTGCCAACACGGCCTCCCTGACCATC
61   S  G  V  S  N  R  F  S  G  S  K  S  G  N  T  A  S  L  T  I

241 TCTCCGCTCCAGACTCAGCACGACCCTGATTATTATTGCGGCTCATATCGCGTCACCACC
81   S  G  L  Q  T  E  D  E  A  D  Y  Y  C  G  S  Y  R  V  S  S

301 TCCTATGTCTTCCGAACTCGCACCAAGGTCACCGTCCTAGCTCAGCCCAAGGCCAACCCC
101  S  Y  V  F  G  T  G  T  K  Y  T  V  L  G  Q  P  K  A  N  P

361 ACTCTCACTCTCTTCCCCCCCTCCTCTGAGGAGCTCCAAGCCAACAAGGCCACACTAGTG
121  T  V  T  L  F  P  P  S  S  E  E  L  Q  A  N  K  A  T  L  V

421 TCTCTGAT
141  C  L

Translation of VH-SG10-Tie1-phagemid.TXT(1-363)
Universal code
Total amino acid number: 121, MW=13390
Max ORF: 1-363, 121 AA, MW=13390
1   GAAGTTCAATTGTTAGAGTCTGGTGGCGGTCTTGTTCAGCCTGGTGGTTCTTTACGTCTT     (SEQ ID NO: 97)
1    E  V  Q  L  L  E  S  G  G  G  L  V  Q  P  G  G  S  L  R  L    (SEQ ID NO: 98)

61  TCTTGCGCTGCTTCCGGATTCACTTTCTCTCGTTACAAGATGTTTTGGGTTCGCCAAGCT
21   S  C  A  A  S  G  F  T  F  S  R  Y  K  M  F  W  V  R  Q  A

121 CCTGGTAAAGGTTTGGAGTGGGTTTCTGTTATCTATCCTTCTGGTGGCCCTACTATGTAT
41   P  G  K  G  L  E  W  V  S  V  I  Y  P  S  G  G  P  T  M  Y

181 GCTGACTCCGTTAAACGTCGCTTCACTATCTCTAGAGACAACTCTAAGAATACTCTCTAC
61   A  D  S  V  K  G  R  F  T  I  S  R  D  N  S  K  N  T  L  Y

241 TTGCAGATGAACAGCTTAAGGGCTGAGGACACTGCAGTCTACTATTGTGCGAGAGGGATG
81   L  Q  M  N  S  L  R  A  E  D  T  A  V  Y  Y  C  A  R  G  M

301 GTCCGTGGATATAGTGGCTACGATTACCCTTTCTTGGACTACTGGGGCCAGGGAACCCTG
101  V  R  G  Y  S  G  Y  D  Y  P  F  L  D  Y  W  G  Q  G  T  L

361 GTC
121  V
```

-continued

Translation of VL-SG10-Tie1-phagemid.TXT(1-333)
Universal code
Total amino acid number: 111, MW=11981
Max ORF: 1-333, 111 AA, MW=11981

```
1   CACAGTGCACAAGACATCCAGATGACCCAGTCTCCATCTTCCCTGTCTGCATCTGTACGG    (SEQ ID NO: 99)
1    H  S  A  Q  D  I  Q  M  T  Q  S  P  S  S  L  S  A  S  V  G    (SEQ ID NO: 100)

61  GACAGACTCACCATCACTTGCCCACCAAGTCAGACCATTAGCAGCTATTTAAATTGGTAT
21   D  R  V  T  I  T  C  R  A  S  Q  T  I  S  S  Y  L  N  W  Y

121 CAGCAGAACCCAGGGAAAGCCCCTAAGCTCCTCATCTATGCTGCATCCAGTTTCCAAAGT
41   Q  Q  K  P  G  K  A  P  K  L  L  I  Y  A  A  S  S  L  Q  S

181 GGGGTCCCATCAAGGTTCAGTGCCAGTGCATCTGGGACAGATTTCACTCTCACCATCAGC
61   G  V  P  S  R  F  S  G  S  G  S  G  T  D  F  T  L  T  I  S

241 AGTCTGCAACCTGAAGATTTTGCAACTTACTACTGTCAACAGACTTACAGTACCCCTCCT
81   S  L  Q  P  E  D  F  A  T  Y  Y  C  Q  Q  S  Y  S  T  P  R

301 ACGTTCGGCCAAGGGACCAAGGTCGAAATCAAA
101  T  F  G  Q  G  T  K  V  E  I  K
```

Translation of VH-SH1-Tie1-phagemid.TXT(1-386)
Universal code
Total amino acid number: 128, MW=13767
Max ORF: 1-384, 128 AA, MW=13767

```
1   GAAGTTCAATTGTTAGAGTCTGGTGGCGGTCTTGTTCAGCCTGGTGGTTCTTTACGTCTT    (SEQ ID NO: 101)
1    E  V  Q  L  L  E  S  G  G  G  L  V  Q  P  G  G  S  L  R  L    (SEQ ID NO: 102)

61  TCTTGCGCTGCTTCCGGATTCACTTTCTCTGCTTACCAGATGGTTTGGGTTCGCCAAGCT
21   S  C  A  A  S  G  F  T  F  S  A  Y  Q  M  V  W  V  R  Q  A

121 CCTGGTAAAGGTTTGGAGTGGGTTTCTTCTATCTATCCTTCTGGTGGCTGGACTTATTAT
41   P  G  K  G  L  E  W  V  S  S  I  Y  P  S  G  G  W  T  Y  Y

181 GCTGACTCCGTTAAAGGTCGCTTCACTATCTCTAGAGACAACTCTAAGAATACTCTCTAC
61   A  D  S  V  K  G  R  F  T  I  S  R  D  N  S  K  N  T  L  Y

241 TTGCAGATGAACAGCTTAAGGGCTGAGGACACTGCAGTCTACTATTGTGCGAGAGGCACG
81   L  Q  M  N  S  L  R  A  E  D  T  A  V  Y  Y  C  A  R  G  T

301 CACCTCCCGGGGGTTGACTACTGGGGCCAGGGAACCCTGGTCACCGTCTCAAGCGCCTCC
101  H  L  P  G  V  D  Y  W  G  Q  G  T  L  V  T  V  S  S  A  S

361 ACCAAGGGCCCATCGGTCTTCCCGCT
121  T  K  G  P  S  V  F  P
```

Translation of VL-SH1-Tie1-phagemid.TXT(1-339)
Universal code
Total amino acid number: 113, MW=12225
Max ORF: 1-339, 113 AA, MW=12225

```
1   CACAGTGCACAAGACATCCAGATGACCCAGTCTCCAGGCACCCTGTCTTTGTCTCCAGGG    (SEQ ID NO: 103)
1    H  S  A  Q  D  I  Q  M  T  Q  S  P  G  T  L  S  L  S  P  G    (SEQ ID NO: 104)

61  GAAAGAGCCACCCTCTCCTGCAGGGCCAGTCAGAGTGTTAGCAGCAGCTACTTAGCCTGG
21   E  R  A  T  L  S  C  R  A  S  Q  S  V  S  S  S  Y  L  A  W

121 TACCAGCAGAAACCTGGCCAGGCTCCCAGGCTCCTCATCTATGGTGCATCCAGCAGGGCC
41   Y  Q  Q  K  P  G  Q  A  P  R  L  L  I  Y  G  A  S  S  R  A

181 ACTGGCATCCCAGACAGGTTCAGTGGCAGTCGGTCTGGGACAGACTTCACTCTCACCATC
61   T  G  I  P  D  R  F  S  G  S  G  S  G  T  D  F  T  L  T  I

241 AGCAGACTGGAGCCTGAAGATTTTGCAGTGTATTACTGTCAGCAGTATGGTAGCTCCCCC
81   S  R  L  E  P  E  D  F  A  V  Y  Y  C  Q  Q  Y  G  S  S  P

301 ATGTACACTTTTGGCCAGGGGACCAAGCTGGAGATCAAA
101  M  Y  T  F  G  Q  G  T  K  L  E  I  K
```

Translation of VH-SH4-Tie1-phagemid.TXT(1-339)
Universal code
Total amino acid number: 113, MW=12481
Max ORF: 1-339, 113 AA, MW=12481

```
1   GAAGTTCAATTGTTAGAGTCTGGTGGCGGTCTTGTTCAGCCTGGTGGTTCTTTACGTCTT    (SEQ ID NO: 105)
1    E  V  Q  L  L  E  S  G  G  G  L  V  Q  P  G  G  S  L  R  L    (SEQ ID NO: 106)

61  TCTTGCGCTGCTTCCGGATTCACTTTCTCTTCTTACAAGATGGGTTGGGTTCGCCAAGCT
21   S  C  A  A  S  G  F  T  F  S  S  Y  K  M  G  W  V  R  Q  A
```

```
                                                        -continued
121 CCTGGTAAAGGTTTGGAGTGGGTTTCTTCTATCTATCCTTCTGGTGGCTGGACTCATTAT
 41  P  G  K  G  L  E  W  V  S  S  P  Y  P  S  G  G  W  T  H  Y 181 GCTGACTCCGTTAAAGGTCGCTTCACTATCTCTAGAGACAACTCTAAGAATACTCTCTAC
 61  A  D  S  V  K  G  R  F  T  I  S  R  D  N  S  K  N  T  L  Y 241 TTGCAGATGAACAGCTTAAGGGCTGAGGACACTGCAGTCTACTATTGTGCAAGAGTACTA
 81  L  Q  M  N  S  L  R  A  E  D  T  A  V  Y  Y  C  A  R  V  L 301 CTACACTACTTTGACTACTGGGGCCAGGGAACCCTGGTC
101  L  H  Y  F  D  Y  W  G  Q  G  T  L  V Translation of VL-SH4-Tie1-phagemid.TXT(1-415)
Universal code
Total amino acid number: 138, MW=14287
Max ORF: 1-414, 138 AA, MW=14287
  1 CACAGTGCACAGAGCGTCTTGACTCAGCCTGCCTCCGTGTCTGGGTCTCCTGGACAGTCG   (SEQ ID NO: 107)
  1  H  S  A  Q  S  V  L  T  Q  P  A  S  V  S  G  S  P  G  Q  S   (SEQ ID NO: 108)

61 ATCACCATCTCCTGCACTGGAACCAGCAGTGACGTTGGTGGTTATAAATATGTCTCCTGC
 21  I  T  I  S  C  T  G  T  S  S  D  V  G  G  Y  K  Y  V  S  W

121 TACCAACAGCACCCAGGCAAAGCCCCCAAACTCATTATTTCTGACGTCAATAATCGGCCC
 41  Y  Q  Q  H  P  G  K  A  P  K  L  I  I  S  D  V  N  N  R  P

181 TCAGGGGTTTCTGATCGCTTCTCTGGCTCCAAGTCTGGCAACACGGCCTCCCTGACCATC
 61  S  G  V  S  D  R  F  S  G  S  K  S  G  N  T  A  S  L  T  I

241 TCTGGGCTCCAGGCTGAGGACGACGGTGATTATTACTGCAGTTCCTACGCAAGTAGTTCC
 81  S  G  L  Q  A  E  D  D  G  D  Y  Y  C  S  S  Y  A  S  S  S

301 TATACAAGCAGTACCACTTGGGTGTTCGGCGGGGGGACCAAGCTGACCGTCCTAGGTCAG
101  Y  T  S  S  T  T  W  V  F  G  G  G  T  K  L  T  V  L  G  Q

361 CCCAAGGCTGCCCCCTTGGTCACTCTGTTCCCACCCTCCTCTGAGGAGCTTCAAG
121  P  K  A  A  P  L  V  T  L  F  P  P  S  S  E  E  L  Q

Translation of Reverse_Complement_K2086117(1-471)
Universal code
Total amino acid number: 157, MW=16967
Max ORF: 1-471, 157 AA, MW=16967

T-G2-Tie1-heavy
       -------------------------Fr1------------------------------
  1 GAAGTTCAATTGTTAGAGTCTGGTGGCGGTCTTGTTCAGCCTGGTGGTTCTTTACGTCTT   (SEQ ID NO: 109)
  1  E  V  Q  L  L  E  S  G  G  G  L  V  Q  P  G  G  S  L  R  L   (SEQ ID NO: 110)

----------------Fr1----------|....CDR1......|-----Fr2-------
 61 TCTTGCGCTGCTTCCGGATTCACTTTCTCTTCTTACAAGATGGGTTGCGTTCGCCAAGCT
 21  S  C  A  A  S  G  F  T  F  S  S  Y  K  M  G  W  V  R  Q  A

--------------Fr2----------|...........CDR2....................
121 CCTCCTAGACGTTTGCACTGGCTTTCTTCTATCTATCCTTCTCCTCCCTGGACTCATTAT
 41  P  G  R  G  L  E  W  V  S  S  I  Y  P  S  G  G  W  T  H  Y

......CDR2......|----------------Fr3----------------------
181 GCTGACTCCGTTAAAGGTCGCTTCACTATCTCTAGAGACAACTCTAAGAATACTCTCTAC
 61  A  D  S  V  K  G  R  F  T  I  S  R  D  N  S  K  N  T  L  Y

------------------------Fr3---------------------------|.CDR3.
241 TTGCAGATGAACACCTTAACCGCTGAGGACACTGCACTCTACTATTCTCCAAGAGTACTA
 81  L  Q  M  N  S  L  R  A  E  D  T  A  V  Y  Y  C  A  R  V  L

.......CDR3......|--------------Fr4------------------
301 CTACACTACTTTGACTACTGCCGCCAGGGAACCCTGGTCACCGTCTCAACCGCCTCCACC
101  L  H  Y  F  D  Y  W  G  Q  G  T  L  V  T  V  S  S  A  S  T

361 AAGCCCCCATCGGTCTTCCCCCTGGCACCCTCCTCCAACACCACCTCCGGGGCACAGCGC
121  K  G  P  S  V  F  P  L  A  P  S  S  K  S  T  G  A  Q  R

421 CCCTCGCCTCCCTGGTCAAGCACTACTTCCCGCCATACCCGTGACGGTGTC
141  P  W  A  A  W  S  R  T  T  S  R  D  T  G  D  G  V
```

-continued

```
Translation of C3-G2_pUCrev(1-325)
Universal code
Total amino acid number: 108, MW=11191
Max ORF: 1-324, 108 AA, MW=11191

T-G2-Tie1-lambda-light
2a2.272A12/DPL11
       ---------------------------Fr1-----------------------------
1   CAGAGCGTCTTGACTCAGCCTGCCTCCGTGTCTGGCTCTCCTCGACAGTCGATCACCATC   (SEQ ID NO: 111)
1    Q  S  V  L  T  Q  P  A  S  V  S  G  S  P  G  Q  S  I  T  I   (SEQ ID NO: 112)

-Fr1-|.....................CDR1..................|----Fr2-----
61  TCCTGCACTCGAACCAGCAGTGACGTTGGTGGTTATAAATATGTCTCCTGGTACCAACAG
21   S  C  T  G  T  S  S  D  V  G  G  Y  K  Y  V  S  W  Y  Q  Q

-------------Fr2-----------------|.........CDR2.......|-Fr3--
121 CACCCACGCAAAGCCCCCAAACTCATTATTTCTCACGTCAATAATCGCCCCTCACCGCTT
41   H  P  G  K  A  P  K  L  I  I  S  D  V  N  N  R  P  S  G  V

----------------------------Fr3-----------------------------
181 TCTCATCGCTTCTCTGGCTCCAACTCTGGCAACACGCCCTCCTCACCATCTCTCGGCTC
61   S  D  R  F  S  G  S  K  S  G  N  T  A  S  L  T  I  S  G  L

-----------Fr3----------------|...............CDR3............
241 CAGGCTCAGGAGGACGCTCATTATTACTGCACTTCCTACGCAAGTAGTTCCTATACAAGC
81   Q  A  E  D  D  G  D  Y  Y  C  S  S  Y  A  S  S  S  Y  T  S

....CDR3...|----Fr4------
301 ACTACCACTTGGGTGTTCGGCGGCC
101  S  T  T  W  V  F  G  G

Translation of DNAMAN12(1-425)
Universal code
Total amino acid number: 141, MW=14855
Max ORF: 1-423, 141 AA, MW=14855

T-E3-Tie1-heavy
        ---------------------------Fr1-----------------------------
1   CAACTTCAATTCTTACACTCTCCTGGCGGTCTTCTTCACCCTCCTCCTTCTTTACCTCTT  (SEQ ID NO: 113)
1    E  V  Q  L  L  E  S  G  G  G  L  V  Q  P  G  G  S  L  R  L  (SEQ ID NO: 114)

---------------Fr1-------------|.....CDR1.....|------Fr2------
61  TCTTCCCCTCCTTCCGGATTCACTTTCTCTATCTACCCTATCCTTTCCCTTCGCCAACCT
21   S  C  A  A  S  G  F  T  F  S  M  Y  G  M  V  W  V  R  Q  A

----------------Fr2---------|...............CDR2.................
121 CCTGGTAAAGGTTTGGAGTGGGTTTCTGTTATCTCTCCTTCTGGTGGCAATACTGGTTAT
41   P  G  K  G  L  E  W  V  S  V  I  S  P  S  G  G  N  T  G  Y

........CDR2.....|------------------Fr3----------------------
181 GCTGACTCCGTTAAAGGTCGCTTCACTATCTCTAGAGACAACTCTAACAATACTCTCTAC
61   A  D  S  V  K  G  R  F  T  I  S  R  D  N  S  K  N  T  L  Y

---------------------------Fr3-----------------------|.CDR3.
241 TTCCAGGTGAACACCCTTAAGGGCTGAGGACACTGCAGTCTACTATTGTCCGAGAGCCCCA
81   L  Q  V  N  S  L  R  A  E  D  T  A  V  Y  Y  C  A  R  A  P

.............CDR3.........|--------------Fr4----------------
301 CGTCGATACAGCTATGGTTACTACTACTCCCCCCAGGCAACCCTCCTCACCGTCTCAAGC
101  R  G  Y  S  Y  G  Y  Y  Y  W  G  Q  G  T  L  V  T  V  S  S

361 GCCTCCACCAAGGGCCCATCGGTCTTCCCCCTACCACCCTCCTCCAAGACCACCTCTCGG
121  A  S  T  K  C  P  S  V  F  P  L  A  P  S  S  K  S  T  S  G

421 GGCAC
141  G

Translation of C1-E3_pUCrev(1-322)
Universal code
Total amino acid number: 107, MW=11650
Max ORF: 1-321, 107 AA, MW=11650

T-E3-Tie1-kappa-light
DPK4/A20+
jk5
        ---------------------------Fr1-----------------------------
1   GACATCCACATGACCCAGTCTCCACTCTCCCTGTCTGCATCTGTAGGACACAGAGTCACC  (SEQ ID NO: 115)
1    D  I  Q  M  T  Q  S  P  L  S  L  S  A  S  V  G  D  R  V  T  (SEQ ID NO: 116)

--Fr1---|.............CDR1..................|-------Fr2--------
```

```
                                                    -continued
 61 ATCACTTCCCGCGCGAGTCAGGGCATTGGCCATTATTTAGCCTGGTATCAGCAGAAACCA
 21  I  T  C  R  A  S  Q  G  I  G  H  Y  L  A  W  Y  Q  Q  K  P ----------Fr2-------------|.........CDR2.......|----Fr3-----
121 GGGAAAGTTCCTAAGCTCCTGATCTATACTGCATCCACTTTGCAATCAGGGGTCCCATCT
 41  G  K  V  P  K  L  L  I  Y  T  A  S  T  L  Q  S  G  V  P  S -----------------------------Fr3----------------------------
181 CGGTTCAGTGGCACTCCATCTGCGACAGATTTCACTCTCACCATCAACAGCCTGCAGCCT
 61  R  F  S  G  S  G  T  D  F  T  L  T  I  N  S  L  Q  P -----------Fr3---------|..........CDR3.........|-----Fr4----
241 CAGGATCTTGCAACTTATTACTGTCAACACTTTAATAGTTACCCTCACACCTTCGGCCAA
 81  E  D  V  A  T  Y  Y  C  Q  Q  F  N  S  Y  P  H  T  F  G  Q ----------Fr4---------
301 GGGACACGACTGGATATTAAAC
101  G  T  R  L  D  I  K
```

Example 4

Alignment

Tables 3 and 4 the list CDR and FR regions of exemplary antibodies, the sequences of which are listed herein.

TABLE 3

Heavy Chain Sequences

| Isolate name | H-FR1 | H-CDR1 | FR2 | H-CDR2 | H-FR3 | H-CDR3 |
|---|---|---|---|---|---|---|
| p-A1 | EVQLLESGGGLVQPG GSLRLSCAASGFTFS | IYKMS | WVRQAPGKGLEWVS | SIYPSGGQTKYADSVKG | RFTISRDNSKNTLYLQMN SLRAEDTAVYYCAR | VNYDSSGYGPIAPGLDY |
| p-A10 | EVQLLESGGGLVQPG GSLRLSCAASGFTFS | SYKMG | WVRQAPGKGLEWVS | WIYPSCGGTTYADSVKG | RFTISRDNSKNTLYLQMN SLRAEDTAVYYCAR | VNYDSSGYGPIAPGLDY |
| p-B1 | EVQLLESGGGLVQPG GSLRLSCAASGFTFS | RYPMV | WVRQAPGKGLEWVS | VISPSGGQTFYADSVKG | RFTISRDNSKNTLYLQMN SLRAEDTAVYYCAR | GVLITTAFDI |
| p-B3 | EVQLLESGGGLVQPG CSLRLSCAASGFTFS | RYGMH | WVRQAPGKGLEWVS | VISPSGGMTYYADSVKG | RFTISRDNTKNTLYLQMN SLRAEDTAVYYCAR | VGATGPFDI |
| p-C6 | EVQLLESGGGLVQPG GSLRLSCAASGFTFS | HYGMT | WVRQAPGKGLENVS | VISPSGGQTGYADSVKG | RFTISRDNSKNTLYLQMN SLRAEDTAVYYCAG | GGYAAFDY |
| p-D12 | EVQLLESGGGLVQPG GSLRLSCAASGFTFS | GYGMH | WVRQAPGKGLEWVS | VISPSGGQTSYADSVKG | RFTISRDNSKNTLYLQMN SLRAEDTAVYYCAR | DRQYYYGSGSLDY |
| p-F3 | EVQLLESGGGLVQPG GSLRLSCAASGFTFS | MYGMG | WVRQAPGKGLEWVS | VISPSGGQTAYADSVKG | RFTISRDNSKNTLYLQMN SLRAEDTAVYYCAR | VALLLGHAFDI |
| p-F4 | EVQLLESGGGLVQPG GSLRLSCAASGFTFS | AYMMS | WVRQAPGKGLEWVS | SIYPSGGYTYYADSVKG | RFTISRDNSKNTLYLQMN SLRAEDTAVYYCAR | GLRGGPDY |
| p-G3 | EVQLLESGGGLVQPG GSLRLSCAASGFTFS | HYMMV | WVRQAPGKGLEWVS | SIYPSGGWTYYADSVKG | RFTISRDNSKNTLYLQMN SLRAEDTAVYYCAR | LDYGGNSAYFDY |
| s-A10 | EVQLLESGGGLVQPG GSLRLSCAASGFTFS | NYVMV | WVRQAPGKGLEWVS | GIYPSGGHTKYADSVKG | RFTISRDNSKNTLYLQMN SLRAEDTAVYYCAR | VNYDSSGYGPIAPGLDY |
| s-H1 | EVQLLESGGGLVQPG GSLRLSCAASGFTFS | AYQMV | WVRQAPGKGLEWVS | SIYPSGGWTYYADSVKG | RFTISRDNSKNTLYLQMN SLRAEDTAVYYCAR | GTHLPGVDY |
| s-A2 | EVQLLESGGGLVQPG GSLRLSCAASGFTFS | RYTMM | WVRQAPGKGLEWVS | GIYPSGGVTLYADSVKG | RFTISRDNSKNTLYLQMN SLRAEDTAVYYCAR | VNYYDSSGYGPIAPGLDY |
| s-B2 | EVQLLESGGGLVQPG GSLRLSCAASGFTFS | IYGMA | WVRQAPGKGLEWVS | VISPSGGQTFYADSVKG | RFTISRDNSKNTLYLQMN SLRAEDTAVYYCAR | VYYYGMDV |
| s-B9 | EVQLLESGGGLVQPG GSLRLSCAASGFTFS | SYVMM | WVRQAPGKGLEWVS | GIYPSGGWTYYTDSVKG | RFTISRDNSKNTLYLQMN SLRAEDTAVYYCAR | VNYYDSSGYGPIAPGLDY |

TABLE 3-continued

Heavy Chain Sequences

| Isolate name | H-FR1 | H-CDR1 | FR2 | H-CDR2 | H-FR3 | H-CDR3 |
|---|---|---|---|---|---|---|
| s-C10 | EVQLLESGGGLVQPG GSLRLSCAASGFTFS | AYGMS | WVRQAPGKGLEWVS | VIYPSGGWTYYADSVKG | RFTISRDNSKNTLYLQMN SLRAEDTAVYYCAR | VNYYDSSGYGPIAPGLDY |
| s-C2 | EVQLLESGGGLVQPG GSLRLSCAASGFTFS | RYKMK | WVRQAPGKGLEWVS | VIYPSGGTGYADSVKG | RFTISRDNSKNTLYLQMN SLRAEDTAVYYCAR | VNYYDSSGYGPIAPGLDY |
| s-C7 | EVQLLESGGGLVQPG GSLRLSCAASGFTFS | RYVMY | WVRQAPGKGLEWVS | VIYPSGGATYYADSVKG | RFTISRDNSKNTLYLQMN SLRAEDTAVYYCAR | RGSSGAFDY |
| s-D11 | EVQLLESGGGLVQPG GSLRLSCAASGFTFS | GYAMW | WVRQAPGKGLEWVS | SISPSGGATAYADSVKG | RFTISRDNSKNTLYLQMN SLRAEDTAVYYCAR | DAGSYYWGWFDP |
| s-E11 | EVQLLESGGGLVQPG GSLRLSCAASGFTFS | GYVMF | WVRQAPGKGLEWVS | GIYPSGGWTVYADSVKG | RFTISRDNSKNTLYLQMM SLRAEDTAVYYCAR | VNYYDSSGYGPIAPGLDY |
| s-G10 | EVQLLESGGGLVQPG GSLRLSCAASGFTFS | RYKMF | WVRQAPGKGLEWVS | VIYPSGGPTMYADSVKG | RFTISRDNSRNTLYLQMN SLRAEDTAVYYCAR | GMVRGYSGYDYPFLDY |
| s-H4 | EVQLLESGGGLVQPG GSLRLSCAASGFTFS | SYKMG | WVRQAPGKGLEWVS | SIYPSGGWTHYADSVKG | RFTISRDNSKNTLYLQMN SLRAEDTAVYYCAR | VLLHYFDY |
| G2 | EVQLLESGGGLVQPG GSLRLSCAASGFTFS | SYMMG | WVRQAPGRGLEWVS | SIYPSGGWTHYADSVKG | RFTISRDNSKNTLYLQMN SLRAEDTAVYYCAR | VLLHYFDY |
| E3 | EVQLLESGGGLVQPG GSLRLSCAASGFTFS | MYGMV | WVRQAPGKGLEWVS | VISPSGGNTGYADSVKG | RFTISRDMSKNTLYLQVN SLRAEDTAVYYCAR | APRGYSYGYYY |

TABLE 4

Light Chain Sequences

| Isolate name | L-FR1 | L-CDR1 | L-FR2 | L-CDR2 | L-FR3 | LCDR3 |
|---|---|---|---|---|---|---|
| p-A1 | QDIQMTQSPGTL SLSPGERATLSC | RASQSVSSSYLA | WYQQKPGQAPRLLIY | GASSRAT | GIPDRFSGSGSGTDFT LTISRLEPEDFAVYYC | QQYGSSRWT |
| p-A10 | QDIQMTQSPCTL SLSPGERATLSC | RASQSVSSSYLA | WYQQKPGQAPRLLIY | GASSRAT | GIPDRFSGSGSGTDFT LTISRLEPEDFAVYYC | QQYGSSPWT |
| p-B1 | QDIQMTQSPSSL SASVGDRVTITC | RASQNINSYLN | WYQQKPGQAPRLLIY | AASNLET | AVPSRFSGSGSGTDFT LTISSLQPEDFATYYC | QQFNTYPLT |
| p-B3 | QDIQMTQSPATL SLSPGERATLSC | RASQSVSTYLA | WYQQKPGQAPRLLIY | DASNRAT | GIPGRFSGSGSGTDFT LTISSLQPEDFAVYYC | QQRSSWPIT |
| p-C6 | QDIQMTQSPATL SLSPGERATLSC | RASQSVSSYLA | WYQQKPGQAPRLLIY | DASNRAT | GIPARFSGSGSGTDFT LTISSLQPEDFAVYYC | QQRSNWPLT |
| p-D12 | QDIQMTQSPSSL SASVGDRVTVTC | RASQSISSYLN | WYQQKPGKAPKLLIY | AASSLQS | GVPSRFSGGGSCTDFT LTISSLQPEDWATYFC | LQDYKYPWT |
| p-F3 | QDIQMTQSPSTL SASLGDRVTITC | RASESISRWLA | WYQQKPGKAPRLLMY | EASTLES | GVPSRFTGTGSGTEFT LTISSLQPDDFATYYC | QQRSNWPLT |
| p-F4 | QDIQMTQSPSTL SAYVGDSVTITC | RASQSVRRSLA | WYQQRPGKAPKSLIY | KASTLET | GVPPRFSGSGSGTEFT LTISSLQPEDSAIYYC | QQYGSFPLT |
| p-G3 | QSVLTQPHSVSA SPGKTVTISC | TRSSGNIASNFVQ | WYQQRPGSVPTTVIY | EDDRRPS | GVPDRFSGSIDSSSNS AFLSISGLKTEDEADYYC | QSHDRTTRAWV |
| s-A10 | QDIQMTQSPGTL SLSPGERATLFC | RASQRVTSNSLA | WYQQRPGQAPRLLIY | DASTRAT | GIPDRFSGSGSGRDFT LTISRLEPEDFAVYYC | QRYGSSVLYS |
| s-H1 | QDIQMTQSPGTL SLSPGERATLSC | RASQSVSSSYLA | WYQQKPGQAPRLLIY | GASSRAT | GIPDRFSGSGSGTDFT LTISRLEPEDFAVYYC | QQYGSSPMYT |
| s-A2 | QDIQMTQSPGTL SLSPGERATLSC | RASRSVIISYVA | WYQQKPGQAPRLLIY | GASTRAT | GIPDRFSGSGSGTDFT LTISRLEPEDFAVYFC | QLYGRSPRII |

TABLE 4-continued

Light Chain Sequences

| Isolate name | L-FR1 | L-CDR1 | L-FR2 | L-CDR2 | L-FR3 | LCDR3 |
|---|---|---|---|---|---|---|
| s-B2 | QDIQMTQSPATL SLSPGERATLSC | RASQSVSSYLA | WYQQKPGQAPRLLIY | DASNRAT | GIPARFSGSGSETDFT LTISSLEPEDFAVYYC | QQRSKWPRT |
| s-B9 | QDIQMTQSPSSL SASVGDRVTITC | RASQSVSSHLS | WFQQRPGKAPNLLIY | HASSLQS | GVPSRFSGSGSGTDFT LTISSLQPEDFATYYC | QQSYATSSIT |
| s-C10 | QDIQMTQSPGTL SLSPGERATLSC | RASQSVSSSYLA | WYQQKPGQAPRLLIY | GASSRAT | GIPDRFSGSGSGTDFT LTISRLEPEDFAVYYC | QQYNNWPRT |
| s-C2 | QSVLTQPDSVSG SPGESITISC | TGSSRDVGGYNYVS | WYQQHPGKAPKLLLY | DVTYRPS | GISGRFSGSKSGDTAS LTISGLRTEDEADYYC | SSSIGTRTYV |
| s-C7 | QSVLTQPASVSG SPGQSITISC | TGTSSDIGRYNYAS | WYQQRPGKSPKLLIY | EVSDRPS | GVSNRFSGSKSGNTAS LIISGLQAEDEADYYC | SSYSSTNSLQVV |
| s-D11 | QDIQMTQSPATL SLSPGERATLSC | RASQSISSYLA | WYQQKPGQPPRLLIY | DASSRVT | GIPARFSGSGFGTDFT LTISSLEPEDFAVYYC | LQRSSWPRT |
| s-E11 | QDIQMTQSPGTL SLSPGERATLSC | RASQSVSSSYLA | WYQQKPGQAPRLLIY | GASSRAT | GIPDRFSGSGSGTDFT LTISRLEPEDFAVYYC | QQYGSSRT |
| s-G10 | QDIQMTQSPSSL SASVGDRVTITC | RASQTISSYLN | WYQQKPGKAPKLLIY | AASSLQS | GVPSRFSGSGSGTDFT LTISSLQPEDFATYYC | QQSYSTPRT |
| s-H4 | QSVLTQPASVSG SPGQSITISC | TGTSSDVGGYKYVS | WYQQHPGKAPKLIIS | DVNNRPS | GVSDRFSGSKSGNTAS LTISGLQAEDDGDYYC | SSYASSSYTSSTTWV |
| G2 | QSVLTQPASVSG SPGQSITISC | TGTSSDVGGYKYVS | WYQQHPGKAPKLIIS | DVNNRPS | GVSDRFSGSKSGNTAS LTISGLQAEDDGDYYC | SSYASSSYTSSTTWV |
| E3 | DIQMTQSPLSLS ASVGDRVTITC | RASQGIGHYLA | WYQQKPGKVPKLLIY | ASTLQS | GVPSRFSGSGSGTDFT LTINSLQPEDVATYYC | QQFNSYPHT |

Example 5

Sequence Alignment of B2 and D11

B2 and D11 are both antagonists of Tie1 since they counteract the agonistic activity of E3 in the Tie1/EpoR chimericBaF3 cell assay. B2 and D11 both have a kappa light chain and are similar in sequence (8 amino acid differences):

```
               <---CDR1--->                    CDR2>
1  (B2)    DIQMTQSPATLSLSPGERATLSCRASQSVSSYLAWYQQKPGQAPRLLIYDASNRAT
           ||||||||||||||||||||||||||||||:||||||||||||:|||||||.|.|
1  (D11)   DIQMTQSPATLSLSPGERATLSCRASQSISSYLAWYQQKPGQPPRLLIYDASNRAT
                                    <-CDR3-->
61         GIPARFSGSGSETDFTLTISSLEPEDFAVYYCQQRSKWPRTFGQGTKLEIK SEQ ID NO:157
           |||||||||| :||||||||||||||||||| |||.||||||||||||||
61         GIPARFSGSGFGTDFTLTISSLEPEDFAVYYCLQRSSWPRTFGQGTKLEIK SEQ ID NO:158
```

Example 6

Inhibition of Tube Formation by HUVEC Cells Using Anti Tie1 E3-IgG

To demonstrate the ability of E3 to inhibit angiogenesis in vitro, purified E3 was tested for its ability to inhibit tube formation by human umbilical cord endothelial cells (HUVECS). Human Umbilical vein endothelial cells (HUVEC) were obtained by treating fresh human umbilical cord veins with Trypsin-EDTA (1×) (Gibco/Invitrogen) for 20-25 minutes at 37° C. The cells were cultured in a T-25 flask coated with attachment factor (AF), (Cascade Biologics) in RPMI 1640 medium supplemented with 10% FCS, 0.4% BBE, 1% 1-glutamin, 1% penicillin/streptomycin. Primary cultures were detached with warm Trypsin-EDTA and used when confluent at the second or third passage. The cells were maintained in a proliferative state by culturing them in a split ratio 1:2 at an approximate density of the monolayer of about 60-80%. To dissociate the cells, HUVEC monolayers were treated with trypsin/EDTA (500 I/dish) at 37° C. for 3 min.

Trypsin activity was stopped by adding 3 volumes of complete RPMI medium. The cells were carefully scraped, separated by repeated pipetting, and finally washed with PBS.

After 2 passages HUVECs were seeded in their culture medium (40.10$^3$/50 µl/well of a 96-well plate) on a collagen gel (50 µl of collagen I 1.5 mg/ml) prepared by mixing 7.5 volumes of 2 mg/ml collagen (Collagen R; Serva, Heidelberg, Germany), 1 volume of 10×MEM, 1.5 volume of NaHCO$_3$ (15.6 mg/ml) and ~1 volume of NaOH to adjust the pH to 7.4. After 1 h30, the culture medium was then discarded and the cells were covered with a new layer of collagen (1.5 mg/ml, new preparation, 50 µl/well). After polymerization of the gel, culture medium was added to each well in presence or in absence of E3 antibody (1 ng/ml to 10 µg/ml). The assay was performed with a streptavidin antibody used as a control (from 1 ng/ml to 10 µg/ml). The total length of the tube network on the culture surface was quantified at ×40 magnification by the METAVUE™ Software (Universal Imaging Corporation). Results from triplicate wells were expressed as mean vessel area per field ±SEM (relative units). Each assay was performed at least three times.

E3 is a potent inhibitor of tube formation by HUVECS even at a concentration of 10 ng/ml. The control anti streptavidin has no effect on the ability of HUVECS to form tubes. This results indicates that E3 can inhibit one aspect of angiogenesis.

Example 7

Immunohistochemical Analysis of E3 Binding to Matched Tumor and Normal Tissue Sections To evaluate the binding of E3 to Tie1 in primary tumor and normal tissue the antibody was produced as an IgG and biotin labeled. The E3 antibody and two other anti Tie1 antibodies B2 and D11 were reformatted as full length IgG molecules. Nucleic acids encoding these IgGs were transiently transfected into HEK293T cells. Plasmid preparations for transient cell transfections were performed using the HP-GENELUTE™ MIDI prep kit (Sigma, cat. no. NA0200). HEK293T cells (GenHunter Corp. cat. no. Q401) were seeded 24 hours before transfection; $6 \times 10^6$ cells were plated per 10-cm culture dish. Transfections were carried out using LIPOFECTAMINE™ 2000 reagent (Invitrogen, cat. no. 11668019) following the manufacturer's instructions. Five micrograms of plasmid DNA was used per 10-cm dish. Cells were cultured in DMEM (Invitrogen, cat. no. 31966021) supplemented with 10% "ultra-low IgG" fetal calf serum (Invitrogen, cat. no. 16250078), at 37° C., 5% $CO_2$, in a water saturated atmosphere. Conditioned media were harvested 72 hours and 144 hours after transfection, pooled and sterile filtered.

One hundred microliters of Protein A beads (rProtein A Sepharose 4 Fast Flow, Amersham Biosciences, cat. no. 17-1279-01) equilibrated in PBS were added to the cell culture supernatants, and these were rotated overnight at 4° C., e.g., in 50 ml tubes. The beads were collected by centrifugation, transferred to a 96-well filter plate (UNI-FILTER 800 GF/B, Whatman, cat. no. 7700-2803) and washed extensively with PBS using a vacuum manifold (Macherey Nagel, cat. no. 760681). Elution of the antibodies was achieved by resuspending the beads in 400 µl of 12.5 mM citric acid. After a 30 to 60 second incubation, the bead eluates were collected, using the vacuum manifold, into the wells of a 96-well collection plate (UNIPLATE 750, Whatman, cat. no. 7701-5750). Each well of the collection plate contained 60 µl of 1 M HEPES pH 7.5 buffer to immediately neutralize the eluted fractions. The elution step was performed twice to maximize antibody recovery. The eluted samples were then dialyzed against PBS using dialysis cassettes (Slide-A-Lyser Dialysis Cassettes, MWCO 10,000, Pierce, cat. no. 66380) and protein concentration was determined from the absorbance at 280 nm assuming that a 1 mg/ml solution has an absorbance of 1.35. The quality of the preparations was analyzed by reducing and non-reducing SDS-PAGE.

The Tie-1 antibodies were biotinylated using the EZ-link Sulfo-NHS-SS-Biotin (Pierce, Cat. 21331). For Tie-1/Fc and Tie-1-His, the reaction was performed for 2 hours on ice in 50 mM sodium carbonate buffer, pH 9.6, in the presence of a 5-fold molar excess of biotinylating agent. For the antibodies, the reaction was performed for 2 hours on ice in PBS, in the presence of a 15-fold molar excess of EZ-link Sulfo-NHS-SS-Biotin. The reaction was stopped by the addition of Tris-HCl, pH 7.5 (50 mM final concentration) followed by a 1-hour incubation on ice. Samples were then dialyzed against PBS.

Various normal and tumor tissue sections were stained with biotinylated antibodies. A mouse monoclonal anti-Tie1 antibody (7e8) (Alitalo laboratory, University of Helsinki) was used as a positive control. Sections without primary antibody served as negative control. All samples were fresh frozen tissues and staining was performed with the TSA-kit (Perkin-Elmer Life Sciences). After acetone fixation (10-20 min, −20° C.) the slides were treated with 0.73% $H_2O_2$ for 10 min to reduce endogenous peroxidase activity followed by blocking for 30 min with TNB buffer. Sections (5-10 mm thick) were incubated with primary antibodies (10 µg/ml) overnight at 4° C. Sections with the mouse monoclonal anti-tie1 antibody (7e8) were treated with biotinylated anti-mouse antibodies (VectaStain) before the addition of streptavidin-HRP. Signal was amplified by using a TSA kit and the visualized by AEC (235 ml NaAc, 15 ml AEC (stock solution: 1600 mg 3-amino-9-ethyl-carbazole and 480 ml N-dimethylformamide), 250 µl $H_2O_2$).

In general, Tie-1 expression was upregulated in tumor tissue when compared with matching normal tissue. However, in the tumor tissues the anti Tie1 antibodies stained other structures in addition to the vessels. Furthermore, some tissue specificity in the expression of certain epitopes was observed. For example, the E3 antibody stained vessels in the lung and kidney but not in the skin while the B2 antibody stained vessels very faintly in other normal tissues than in the breast. Shedding of the ectodomain of Tie-1 into the tumor tissues can explain observed differences.

In skin tissue, the E3, B2, and D11 antibodies stained blood vessels very faintly whereas the murine 7e8 control antibody gave a clear staining in the normal skin. In melanoma tissue, the 7e8 antibody stained vessels only but the E3, B2, and D11 antibodies also stained other surrounding structures. The staining pattern was similar with all three of the E3, B2, and D11 antibodies antibodies.

In lung tissue, we observed that the E3 antibody stained especially clearly the large veins in the lung, whereas D11 and 7e8 gave a faint staining. B2 did not stain the same veins. The expression of Tie-1 was dramatically upregulated in lung carcinoma and all the antibodies stained vessels more strongly in samples with lung carcinoma than in samples from normal lung. In the lung tumors, the E3, B2, and D11 antibodies stained structures other than vessels.

In kidney, the E3 and D11 antibodies stained kidney tubules in addition to the vessels. B2 gave only very faint staining of either tubules or vessels while 7e8 stained only vessels. In hypernephroma tissue, only the E3 antibody gave a clear staining.

In breast, E3 gave the brightest staining in the veins and capillaries of the mammary tissue, B2 and 7e8 gave a similar staining while D11 stained those structures rather faintly. In breast carcinoma the Tie-1 expression was substantially upregulated, and the E3, B2, and D11 antibodies stained also other structures in addition to vessels.

Example 8

Binding to Mouse Endothelial Cell Lines of Anti Tie1 E3-IgG Using Flow Cytometry We evaluated if E3 cross reacts with mouse Tie1 in situ and thus if we can evaluate E3 activity in mouse tumor xenograft models binding to mouse endothelial cells was tested and compared with human and transfected cell lines.

Specific binding of the Tie-1 antibodies and of control Mabs to mouse endothelial cells was measured by flow cytometry analysis (FACSscan, Becton Dickinson, Oxnard, Epics, Coulter). Mouse endothelial cell lines MS1, Le-2, Bend3, SVEC (ATCC, Rockville) and Tie-1 transfected Le-2 cells were stained. Cell staining was modified from existing protocols. About 200,000 cells were used in each experiment: after trypsinization, cells were washed one time in PBS and resuspended PBS, 10% Heat inactivated human serum (incubation buffer). To test specificity, antibodies were incubated at different dilutions for 1 h at room temperature. Cells were spun down by centrifugation for 3 min at 611 g. Between incubations cells were washed twice with PBS. Then relevant biotinylated antibodies (A2 against streptavidin, E3 against Tie-1, were added and incubated for 1 h at room temperature). This was followed by incubation with Strepatvidin-R-phycoerythrin (Dako, Glostrup, Denmark) for 1 hour at room temperature in incubation buffer. After the final incubation step bound antibodies were detected by means of flow cytometry on a FACSCan and Epics Altra (Becton Dickinson, Oxnard, Coulter) and results analyzed.

Intracellular Tie-1 was measured as described above, except for the addition of Saponin to the incubation buffer to a final concentration of 0.1% during incubations. The anti-Tie-1 antibody E3 binds to mouse endothelial cell lines indicating a cross reactivity of E3 with mouse and human Tie1 in situ. The binding pattern in mouse cell lines detected by flow cytometry is different from the binding pattern in HUVEC in that in mouse cells there is a greater cell surface staining than that compared to primary human endothelial cell lines.

Example 9

Determination of Anti Tie1 E3-IgG Binding to Human Platelets Using Flow Cytometry Binding experiments with a purified polyclonal goat antiserum against Tie-1 (R&D systems) had showed binding to human platelets in a previous study (Tsiamis et al., 2000). The conclusion form this study was that platelets represent a large pool of Tie-1 immunoreactivity which could present a problem for development of Tie1 as a therapeutic target. To determine if the antibody E3 binds to platelets we performed flow cytometric analysis on both activated and inactivated platelets and compared the staining pattern with the purified anti Tie1 polyclonal serum.

To avoid platelet activation, human platelets were isolated from plasma of healthy donors using the platelet GelSep kit (Biocytex, Marseille, France) kit according to the guidelines of the manufacturer. Platelets were activated by the addition of thrombin to a final concentration of 0.8 U/ml. To distinguish activated from non-activated platelets double staining was performed with Tie-1 antibodies/control antibodies and antibody CD42 (total platelets) or CD62 (activated platelets).

After preparation, platelets were resuspended in buffer 2 of the GelSep kit, 10% heat inactivated human serum (incubation buffer) and incubated for 1 hour. To test specificity, biotinylated antibodies human anti-Tie1 (E3), human anti-streptavidin (A2-SV, an antibody that does not bind Tie1), human anti-FITC and goat anti-Tie (R&D systems) were incubated with 500 000 platelets per test for 1 hour at different dilutions (2 µg/ml, 10 µg/ml) for 1 h at room temperature. Platelets were spun down by centrifugation for 10 min at 611 g. Between incubations platelets were washed twice with Buffer 1 of the GelSep kit. Then, Strepatvidin-R-phycoerythrin together with anti-CD42-PercP or anti-CD62-PercP were incubated for 30 minutes at room temperature in incubation buffer After the last incubation and washing detection of bound antibodies was performed by means of flow cytometry on a FACSscan and Epics Altra (Becton Dickinson, Oxnard, Coulter) and results analyzed. Cells were gated on SSC and anti-CD42-PercP for the total platelets in case non-activated platelets were used and on SSC and anti-CD62-PercP for the activated platelets.

The polyclonal goat anti-Tie-1 antibody indeed binds to platelets under the conditions tested. This binding is lower when platelets are activated. In contrast, the human anti-Tie1 antibody E3 shows no significant binding to total platelets, nor to activated platelets.

Example 10

Assessment of Tie1 Immunoreactivity in Human Platelets Using Immunoprecipitation with Anti Tie1 E3-IgG A previous study with a purified polyclonal goat antiserum against Tie-1 (R&D Systems) had showed binding to human platelets (Tsiamis et al., 2000). The conclusion from this study was that platelets represent a large pool of Tie-1 immunoreactivity which could present a problem for development of Tie1 as a therapeutic target. To exclude the possibility that the antibody E3 binds to platelets immunoprecipitation of lysates prepared from platelets and HUVECS were performed. Both, activated and inactivated platelets were tested. Anti-Tie-1 antibodies B2, D11, E3, the goat polyclonal AF619 (R&D) and negative control antibodies anti-FITC and anti-Streptavidin were used. HUVECS were retrieved from culture dishes by trypsinization and platelets were prepared with the platelet GelSep kit (Biocytex, Marseille, France) kit according to the guidelines of the manufacturer. Per immunoprecipitation experiment $3-5e10^6$ and $3e10^8$ cells platelets were used for each antibody tested. Platelets and cells were washed with PBS and spun down at 1400 rpm for 4 minutes and supernatant was removed. Then cells were lysed in 1 ml lysis buffer containing 50 mM Tris HCL pH 7.5, 150 mM NaCl, 0.5% Deoxycholic acid (DOC) and 0.5% NP-40 for 5 minutes. The lysed cells were spin down for 10 minutes at 14.000 rpm and 5 µg/ml antibody was added to the supernatant and incubated at 4° C. on a rotator. 100 µl/sample protein A beads (Uppsala, Sweden) were washed 3 times with lysis buffer (centrifugation speed: 1.5 seconds, 2000 rpm) then cell lysates incubated with antibody were added for 30 minutes 4° C. Then beads were washed three times with washing buffer containing 50 mM Tris HCL pH 7.5, 400 mM NaCl, 0.5% DOC, 0.5% NP-40. Finally, beads are spun down and the pellets was resuspended in an equal amount in sample buffer to perform SDS-page and Western blotting. In Western blotting Tie-1 was detected with the polyclonal goat anti-Tie-1 antibody. The conclusions of this study are that E3 is able to immune precipitate Tie-1 in HUVEC but not in platelets.

Example 11

Distribution of Tie1 in HUVEC Cells Determined by Staining with Anti Tie1 E3-IgG We analyzed the staining pattern of E3 in HUVECS using confocal microscopy. HUVEC were trypsinised, washed with PBS and spotted at a density of 60 000 cells on a gelatine coated microscope slide and incubated for 24 hours in a humidified incubator at 37° C. Cells were air dried and fixed with 4% paraformaldehyde for 20 minutes at room temperature. The slides were washed with PBS. The slides were incubated with 10% Heat inactivated human serum (incubation buffer).

For measuring specific binding to Tie-1, biotinylated antibody E3 and biotinylated negative control antibody A2 were used at a concentration of 10 µg/ml and incubated for 1 hour at room temperature. Slides were washed twice with PBS. Then, Strepatvidin-R-phycoerythrin (Dako, Glostrup, Denmark) was added and incubated for 1 hour at room temperature. After the last incubation and washing detection of bound antibodies was performed by means of confocal microscopy.

E3 binds specifically to HUVEC as detected by confocal microscopy. The staining is pre-dominantly located inside of the cell which suggests a large intracellular pool of Tie1 relative to a smaller pool of cell surface localized Tie1. The localization of E3 was consistent with co-localization of Tie1 with a cytoskeletal protein.

Example 12

Conversion of Somatic Mutations Positioned in the Framework Region of Anti Tie1 E3 to Germline Residues To reduce potential immunogenicity of E3 in humans, all non germline amino acid residues in the LC framework regions were corrected back to germline. An initial analysis was performed which aligned the LC of E3 with a database containing all kappa and lambda light chain germline genes. The LC of E3 was shown to have closest homology to DPK4 and three substitutions in E3 relative to the germline framework regions were identified.

We constructed a germlined version of E3 in which the LC framework regions were altered to include sequences identical to the DPK4 germline framework regions. The germlined E3 antibody was constructed by engineering a nucleic acid encoding the desired sequence. Changes to nucleic acids encoding the E3 LC variable domain were made by PCR and other standard molecular biological techniques and verified by nucleic acid sequencing.

An exemplary germlined light chain variable domain E3 sequence includes:

(SEQ ID NO: 159)
DIQMTQSP<u>S</u>SLSASVGDRVTITCRASQGIGHYLAWYQQKPGKVPKLLIYT
ASTLQSGVPSRFSGSGSGTDFTLTI<u>SS</u>LQPEDVATYYCQQFNSYPHTFGQ
GTRL<u>E</u>IK

The altered positions are underscored.

We produced the germlined version of the E3 antibody as both a soluble Fab and as an IgG. The Fab cassette of the positive sFAB-expressing clone was PCR amplified with oligonucleotides, ligated into a mammalian expression vector containing the human IgG4 Fc region and electroporated into XL1 Blue MRF' cells. The prokaryotic ribosomal binding sequence and gene three leader sequence were replaced with a mammalian internal ribosomal entry and heavy chain leader sequences. Reformatted antibody clones were sequenced to confirm accuracy following the cloning procedure. Endotoxin-free DNA was prepared and used for transient transfection studies.

Example 13

Production and Testing of Germlined Anti Tie1 E3-Fab for Binding to Recombinant Tie1-Fc in ELISA To evaluate if the conversion of any of the somatic mutations in the framework of E3 back to germline residues had any effect on binding activity the soluble Fabs were produced. The soluble expression vector containing the parental E3 Fab and the germlined E3 Fab construct were grown overnight at 30° C. in 2×TY broth containing 100 µg/ml ampicillin and 2% glucose and use 4 ml of this overnight culture to inoculate 400 ml of 2×TY broth containing 100 µg/ml ampicillin and 0.1% glucose. Cells were grow at 37° C. until an $OD_{600}$ of 0.8-1.0, 1 mM IPTG was added and the culture was maintained at 30° C. for 4 hours. The cultures were spun down at 4,000 rpm for 15 min at 4° C. The supernatants were discarded and resuspend the pellets resuspended in 4.8 ml of ice cold TES buffer (0.2 M Tris-HCl, 0.5 mM EDTA, 0.5 M sucrose, pH 8.0) containing proteases inhibitors (protease inhibitor cocktail tablets [Roche]: dissolve 1 tablet in 1 ml of water and dilute 50-times in TES buffer). Transfer to 50 ml Falcon tubes and place on ice for 5-10 min. During this incubation, wash the centrifugation bottles with 5.25 ml TES:$H_2O$ (1:3) containing proteases inhibitors and add this to the cells. Incubate for 20 more min on ice. Spin at 3000 g for 15 min at 4° C. and transfer the supernatants into new centrifugation tubes. Resuspend the cell pellets in 6 ml TES containing 15 mM $MgSO_4$ and proteases inhibitors and incubate on ice for 15 min. Centrifuge at 3000 g for 15 min at 4° C. Transfer the supernatants into the centrifugation tubes and spin at 8000 g for 20 min at 4° C. Collect the supernatants and dialyze against PBS. The Fabs were purified by metal chelate chromatography. Incubate the dialyzed periplasmic extracts with 1 ml of TALON™ Metal Affinity Resin (Clontech) and rotate at room temperature for 2 hours. Transfer the beads into empty gravity column (Poly-Prep chromatography columns, Bio-Rad, Cat. 731-1550). Wash the beads with 5 mM imidazole in PBS and elute the Fabs with 150 mM imidazole in PBS. Dialyze against PBS using dialysis cassettes (SLIDE-A-LYSER™ Dialysis Cassettes, MWCO 10,000, Pierce, cat. no. 66380) and determine the protein concentration from the absorbance at 280 nm assuming that a 1 mg/ml solution has an absorbance of 0.86. The quality of the preparations can be analyzed by reducing and non-reducing SDS-PAGE.

Wells of an IMMULON™ 2 HB plate coated overnight with 500 ng or 50 ng of purified recombinant human Tie-1-Fc target antigen per 100 microliters 0.1 M sodium bicarbonate buffer, pH 8.5. Parental E3, E3 germlined (E3g) or a negative control soluble Fab were loaded into wells at either 5 micrograms or 1 microgram per 100 microliters of PBST. Recombinant human Tie-1-Fc target antigen is dissolved in an appropriate amount of acetic acid and subsequently diluted into 0.1 M sodium bicarbonate buffer, pH 9.6 at final concentrations of 500 ng and 50 ng per 100 microliters. After addition of the target antigen to the wells the microtitre plate is incubated overnight at 4° C. The plate is subsequently washed 5 times with PBST and blocked with 1% BSA in PBS at 37° C. for 2 hours. The plate is again washed plate times with wash buffer, PBST and 100 microliters per well of purified Fab at 5 or 1 micrograms per 100 microliter PBST was added followed by incubation at room temperature for 1 hour. After washing plate 7 times with PBST 100 microliters of a 1:5000 dilution of anti-sFab-HRP in PBST was added (Pierce Product #31414). After washing the wells seven times 100 microliters TMB-$H_2O_2$ solution was added to each well and the plate read at 630 nm in an ELISA. Both E3 and germlined E3 bound to the recombinant human Tie-1-Fc target antigen by this assay.

Example 14

Production and Testing of Germlined Anti Tie1-E3-Fab for Binding to Recombinant Human Tie1 in BIAcore Recombinant purified human Tie1-Fc antigen (Stock 2.45 mg/ml) was biotinylated using the EZ-link Sulfo-NHS-SS- Biotin (Pierce, Cat. 21331). The reaction was performed for 2 hours on ice in 50 mM sodium carbonate buffer, pH 9.6, in the presence of a 5-fold molar excess of biotinylating agent and was stopped by the addition of Tris-HCl, pH 7.5 (50 mM final concentration) followed by a 1-hour incubation on ice. Samples were then dialyzed against PBS. The antigen was then diluted 1/100 fold in HBS and was then captured onto a streptavidin chip. This was coated to a density of 830RU (resonance units). All analysis was performed in HBS buffer. The parental Fab E3 and germlined E3 Fab were prepared as described above. A stock solution of 0.587 mg/ml (11740 nM) was diluted 1/587 in HBS+BSA to obtain a stock of 20 nM and the germlined Fab E3 0.025 mg/ml (500 nM) was diluted 1/25 in HBS+BSA to obtain a stock of 20 nM. Serial dilutions were made of each Fab preparation to obtain 10 nM, 5 nM, 2.5 nM, and 1.25 nM solutions. For the association phase samples were injected at 30 µl/min for 4 minutes using kinject program. This was followed by a 10 minutes dissociation phase, any remaining sample was stripped from the Tie-1 Fc surface at a flow of 50 µl/min with a single injection of 5 mM NaOH+1M NaCl for 18 seconds. All samples were run and analyzed in duplicate.

Sensorgrams were analyzed using the simultaneous ka/kd fitting program with 1:1 model in the BIAEVALUATION™ software 3.1. From the analysis we can see that the germlining of the E3 antibody has had minimal effect on the binding activity of the antibody.

TABLE 5

Comparison of the binding affinity of parental and germlined E3 Fab

| E3 Fab | Tie-1 Fc | ka (1/Ms) | kd (1/s) | KD(1) nM |
|---|---|---|---|---|
| parental | Human | 3.00E+05 | 6.10E−04 | 2.0 |
| germilned | Human | 3.00E+05 | 1.02E−03 | 3.4 |

Example 15

Comparison of Affinity of Germlined Anti Tie1 E3-IgG to Parental Anti Tie1 E3 for Binding to Recombinant Human Tie1 Using BIAcore In order to evaluate if the binding behavior had been affected in any way by the conversion of the somatic mutations back to germline residues, the germlined antibody was produced and tested as an IgG. The germlined E3-IgG construct used to transiently transfect HEK293T cells and purified.

The germlined E3 IgG1 stock solution 0.63 mg/ml was diluted 1/50 in a buffer of pH4.5 and the parental E3 IgG1 stock solution 0.56 mg/ml (2143-001) was diluted 1/50 in a buffer of pH 4.5. The IgG were directly coated onto a CM5 chip. The surface of the chips was activated with a 7 minute pulse of 0.05M NHS/0.2M EDC and the IgG was flowed over until 780RU germlined E3-IgG and 728 non germlined E3 IgG was coated onto the surface. All flow cells were subsequently deactivated with a 7 minute pulse of 1M ethanolamine hydrochloride pH 8.5. All analysis was performed in HBS buffer. Purified recombinant human Tie-1 Fc was diluted 1/28.7 in HBS to obtain a 400 nM stock solution. Serial dilutions were made to obtain 200 nM, 100 nM, 50 nM and 25 nM Tie-1 Fc stocks. For analysis of the association phase samples were injected at 30 µl/min for 8.3 minutes using kinject program. This was followed by a 40 minutes dissociation phase. Any antigen remaining associated to the surface was stripped from the IgG surface at a flow of 50 µl/min with two injections of 10 mM glycine pH 1.5 for 30 secods. All samples were run and analyzed in duplicate Sensorgrams were analyzed using the simultaneous ka/kd fitting program with 1:1 model in the BIAEVALUATION™ software 3.1. Germlining had minimal impact on the binding activity of the E3 IgG with respect to human Tie1 Fc.

TABLE 6

Comparison of the binding affinity of parental and germlined E3 IgG

| E3 IgG | Tie-1 Fc | ka (1/Ms) | kd (1/s) | KD(1) nM |
|---|---|---|---|---|
| parental | Human | 6.19E+03 | 3.61E−05 | 5.83 |
| germlined | Human | 7.09E+03 | 3.67E−05 | 5.17 |

Example 16

Production and Testing of Germlined Anti Tie1-E3-Fab for Binding to Recombinant Mouse Tie1 in BIAcore Mouse Tie 1-Fc antigen (0.5 mg/ml stock) was biotinylated using established procedures and after dilution 1/100 fold in HBS this was then used for capturing to a streptavidin chip. This was coated to a resonance value of 740RU. All analysis was performed in HBS buffer. The parental Fab E3 0.587 mg/ml (11740 nM) was diluted 1/587 in HBS+BSA to obtain a stock of 20 nM and the germlined Fab E3 0.025 mg/ml (500 nM) was diluted 1/25 in HBS+BSA to obtain a stock of 20 nM. Serial dilutions were made of each Fab preparation to obtain 10 nM, 5 nM, 2.5 nM, and 1.25 nM. For the association phase samples were injected at 30 µl/min for 4 minutes using kinject program. This was followed by a 10 minutes dissociation phase, any remaining sample was stripped from the Tie-1 Fc surface at a flow of 50 µl/min with a single injection of 50 mM NaOH+1 M NaCl for 18 seconds. All samples were run and analyzed in duplicate.

Sensorgrams were analyzed using the simultaneous ka/kd fitting program with 1:1 model in the BIAEVALUATION™ software 3.1. The germlining of the E3 antibody has had minimal effect on the binding activity of the antibody.

TABLE 7

Comparison of the binding affinity of parental and germlined E3 Fab

| E3 Fab | Tie-1 Fc | ka (1/Ms) | kd (1/s) | KD(1) nM |
|---|---|---|---|---|
| parental | Mouse | 2.46E+05 | 9.50E−04 | 3.9 |
| germlined | Mouse | 3.40E+05 | 1.04E−03 | 3.1 |

Example 17

Comparison of Affinity of Germlined Anti Tie1 E3-IgG to Parental Anti Tie1 E3 for Binding to Recombinant Mouse Tie1 Using BIAcore In order to evaluate if the binding behavior had been affected in any way by the conversion of the somatic mutations back to germline, the germlined antibody was produced and tested as a IgG. The germlined E3 was reformatted to an IgG as described. This was then used to transiently transfect HEK293T cells using established procedures. The IgG was purified from the culture supernatant using protein A column chromatography using established procedures and the subsequent IgG was then tested for binding activity using surface plasmon resonance (BIAcore). The germlined E3 IgG1 stock solution 0.63 mg/ml (2146-002) was diluted 1/50 in a buffer of pH 4.5 and the parental E3 IgG1 stock solution 0.56 mg/ml (2143-001) was diluted 1/50 in a buffer of pH 4.5. The IgG were directly coated via onto a CM5 chip. The surface of the chips was activated with a 7 minute pulse of 0.05M NHS/0.2M EDC and the IgG was flowed over until 780RU germlined E3-IgG and 728 non germlined E3 IgG was coated onto the surface. All flow cells were subsequently deactivated with a 7 minute pulse of 1M ethanolamine hydrochloride pH8.5. All analysis was performed in HBS buffer. Purified recombinant mouse Tie-1 Fc was diluted 1/6.5 in HBS to obtain a 400 nM stock solution. Serial dilutions were made to obtain 200 nM, 100 nM, 50 nM and 25 nM Tie-1 Fc stocks. For analysis of the association phase samples were injected at 30 µl/min for 8.3 minutes using kinject program. This was followed by a 40 minutes dissociation phase. Any antigen remaining associated to the surface was stripped from the IgG surface at a flow of 50 µl/min with two injections of 10 mM glycine pH1.5 for 30 seconds. All samples were run and analyzed in duplicate Sensorgrams were analyzed using the simultaneous ka/kd fitting program with 1:1 model in the BIAEVALUATION™ software 3.1. The germlining process had minimal impact on the binding activity of the E3 IgG with respect to mouse Tie1-Fc.

TABLE 8

Comparison of the binding affinity of parental and germlined E3 IgG

| E3 IgG | Tie-1 Fc | ka (1/Ms) | kd (1/s) | KD(1) nM |
|---|---|---|---|---|
| parental | Mouse | 6.17E+03 | 9.20E−05 | 14.9 |
| germlined | Mouse | 6.00E+03 | 8.99E−05 | 15 |

Example 18

Comparison of $IC_{50}$ of Germlined Anti Tie1-E3 and Parental Anti Tie1-E3 in Tube Formation Assays using HUVEC Cells Germlined E3 and its parental antibody were evaluated in the tube formation assay in a collagen type-I matrix. Human Umbilical vein endothelial cells (HUVEC) (freshly isolated) were obtained by treating human umbilical cord veins with Trypsin-EDTA (1×) (Gibco/Invitrogen) for 20-25 minutes at 37° C. The cells were then cultured in a T-25 flask coated with attachment factor (AF), (Cascade Biologics) in RPMI 1640 medium supplemented with 10% FCS, 0.4% BBE, 1% l-glutamin, 1% penicillin/streptomycin. Primary cultures were detached with warm Trypsin-EDTA and used when confluent at the second or third passage. During culturing, the cells were kept in a proliferative state by culturing them in a split ratio 1:2 at an approximate density of the monolayer of about 60-80%. HUVEC monolayers were treated with trypsin/EDTA (500 µl/dish) at 37° C. for 3 min. Trypsin activity was stopped by adding 3 volumes of complete RPMI medium. The cells were carefully scraped, separated by repeated pipetting, and finally washed with PBS. HUVECs (passage 2) were seeded in their culture medium ($40.10^3$/50 µl/well of a 96-well plate) on a collagen gel (50 µl of coll I 1.5 mg/ml) prepared by mixing 7.5 volumes of 2 mg/ml collagen (Collagen R; Serva, Heidelberg, Germany), 1 volume of 10×MEM, 1.5 volume of $NaHCO_3$ (15.6 mg/ml) and ~1 volume of NaOH to adjust the pH to 7.4. After 1 h30, the culture medium was then discarded and the cells were covered with a new layer of collagen (1.5 mg/ml, new preparation, 50 µl/well). After polymerization of the gel, culture medium was added to each well in presence or in absence of E3 antibody or germlined E3 antibody (0.1 ng/ml to 100 ng/ml). The total length of the tube network on the culture surface was quantified at 40× magnification by the METAVUE™ Software (Universal Imaging Corporation). Results from triplicate wells were expressed as mean vessel area per field ±SEM (relative units). Each assay was performed at least three times. The conclusions are that conversion of the three somatic mutations to germline amino acids in E3 has had little effect on the potency of E3. Both parental E3 and germlined E3 inhibit tube formation in vitro with an essentially identical $IC_{50}$=10 ng/ml, i.e. 66 pM.

Example 19

Analysis of Germlined Anti Tie1-E3 in Tube Formation Assays With Mouse Endothelial Cells In order to assess mouse Tie-1 cross-reactivity and biological activity on mouse Tie1, both E3 and germlined E3 were evaluated for their ability to inhibit tube formation in vitro using mouse endothelial cell line (LEII).

LEII lung mouse endothelial cell line (ATCC) was cultured in a T-25 flask in MEM medium with GLUTAMAX™ (Life Technologies Ltd., Paisley, Scotland) supplemented with 10% FCS, and 1% penicillin/streptomycin. During culturing, the cells were kept in a proliferative state by culturing them in a split ratio 1:5 at an approximate density of the monolayer of about 80%. LEII monolayers were treated with trypsin/EDTA (500 µl/dish) at 37° C. for 3 min. Trypsin activity was stopped by adding 3 volumes of complete MEM medium. The cells were carefully scraped, separated by repeated-pipetting, and finally washed with PBS.LEII cells were seeded in their culture medium ($20-40\times10^3$/50 µl/well of a 96-well plate) on a basement membrane (BIOCOAT™ Angiogenesis System; Becton Dickinson). After polymerization of the MATRIGEL™ (30 min at 37° C., 5% $CO_2$ environment) the endothelial cell suspension resuspended in complete culture medium in the presence of the desired molecules ($4.10^5$ cells/ml; 50 µl/well) was added to each well. The angiogenesis assay plate was then incubated for 16 to 18 hours at 37° C., 5% $CO_2$ atmosphere. The total length of the tube network was then quantified at 40× magnification by the METAVUE™ Software (Universal Imaging Corporation). Results from triplicate wells were expressed as mean vessel area per field ±SEM (relative units). Each assay was performed at least two times. Germlined E3 is a potent inhibitor of tube formation in mouse endothelial cells.

Example 20

Immunohistochemical Analysis of Mouse Tumor Tissue Sections Using Anti Tie1-E3 IgG We determined if antibody E3 binds to mouse endothelial cells in mouse xenographs. Immunohistochemistry was performed with biotinylated E3 IgG1 (a,z allotype) antibody and control antibodies anti-CD31 (endothelial cell specific marker) and anti-PCNA (proliferating cell nuclear antigen). Formalin-fixed tumor tissues from a mouse-xenograph containing SW480 cells (ATCC) were tested for the binding pattern of the human anti-Tie1 antibody E3. 5 µm sections of paraffin embedded tissues were deparaffinized, rehydrated and pretreated with warm the citrate buffer (0.01 M sodium citrate, pH6 at 95° C.) for 45 min. The slides were cooled down in fresh citrate buffer for 20 min and rinsed with distilled water. The slides were hydrogen peroxide treated, (0.3% $H_2O_2$ in PBS), and preincubated with PBS, 5% FCS, 5% heat inactivated human serum (HS) for 1 hour. Between antibody incubations slides were washed 3 times 5 minutes in PBS. Biotinylated antibodies E3 and A2-SV were diluted to a concentration of 10 μg/ml in PBS, 10% HS and incubated for 1 hour at RT. Slides were then incubated with an avidin-HRP (Dako) for 30 minutes at room temperature. Staining was detected by AEC (Vector Laboratories, Burlingame) and $H_2O_2$. The peroxidase reaction was stopped with water and slides were counter-stained with haematoxylin. The tissues were evaluated for their binding reactivity. The staining pattern was consistent with staining of mouse endothelial cell Tie-1 and also with Tie1 expressed by the E3 binds to Tie-1 expressed by SW480 tumor cells in a mouse xenograft.

Example 21

E3 Activity in a MATRIGEL™ Plug Assay

The germlined variant of the E3 IgG antibody was evaluated in an in vivo assay for angiogenesis induced by bFGF in MATRIGEL™ plugs. Growth factor reduced MATRIGEL™ (BD Biosciences, catalog # 354230) was supplemented with 80 ng/ml of bFGF (R&D Systems, catalog #234-FSE). The A2-SV or an IgG4 E3 antibody (10 μg/ml) or PBS was injected subcutaneously into the abdominal area of NMRI nu/nu mice (150 μl of Matrigel/plug).

In the first assay, two mice were injected with MATRIGEL™ supplemented with bFGF and soluble VEGFR-1 (10 μg/ml) as a positive control for an angiogenic inhibitor. At day 7 post-implantation mice were anesthetized and perfused through heart with 4% paraformaldehyde (PFA) in phosphate buffered saline (PBS). MATRIGEL™ plugs and a piece of liver were removed and embedded in paraffin. Sections were cut and stained with hematoxylin and eosin (H&E).

The staining revealed modification of MATRIGEL™ and formation of vessel-like structures in the PBS and A2-SV antibody treated plugs. Even though the E3 antibody and soluble VEGFR1 supplemented plugs contained single cells, there were neither modification of the matrix nor organization of the cells observed in these plugs. This results indicates that the germlined E3 antibody inhibits angiogenesis in MATRIGEL™ in vivo.

In a second assay, mice were treated as described above, and then anesthetized eight days post-implantation and injected with fluorescein-conjugated tomato (*lycopersicon esculentum*) lectin (100 μg in 200 μl of PBS; Vector, catalog #FL-1171) into the tail vein. After five min circulation the animals were perfused through the heart with 10 ml of PBS followed by 10 ml of 4% PFA in PBS. MATRIGEL™ plugs and pieces of kidney and liver were removed and frozen in OCT (Tissue-Tek). Nuclei were visualized on sections by using VECTASHELD® mounting medium containing DAPI (Vector) and analyzed under fluorescence microscopy.

Staining of the MATRIGEL™ with fluorescein lectin revealed stain-positive material for the PBS and control antibody (A2-SV) containing plugs, but no staining could be detected in the E3 antibody containing plugs. As a control, the blood vessels of the kidney and liver from the same mice showed nice staining with the fluorescent lectin.

Results from these two experiments suggest that the anti-Tie1 antibody E3 can inhibit bFGF-induced angiogenesis in vivo.

Example 22

Evaluating Effects of Ligands on Complex Formation

A candidate protein (for example, E3 or E3b antibody) that binds a complex member, such as Tie1, Tie2, or an angiopoietin is tested for its ability to antagonize formation of a heteromeric complex that includes Tie1, Tie2, and Ang, by inhibiting its formation or disrupting the heteromeric complex once it forms.

To test the ability of a candidate protein to disrupt complex formation, cells expressing Tie1 and Tie2 are treated with Ang for a period of time sufficient to allow binding of Ang to Tie1 and/or Tie2. The cells are contacted with the candidate protein for a period of time sufficient to allow disruption of the complex. The cells are treated with a membrane non-permeable cross-linker, such as DTSSP, to chemically cross-link the proteins. Cell lysates are prepared and subjected to immunoprecipitation with an antibody specific to a complex member. The immunoprecipitated proteins are separated by SDS-PAGE electrophoresis and immunoblotted with antibodies specific to the complex members. A positive control immunoprecipitation-immunoblot is also performed in which cells expressing Tie1 and Tie2 are treated with Ang but not with the candidate protein or are treated with a nonspecific protein. If treatment with the candidate protein decreases the amount of a complex member—that is not bound by the immunoprecipitating antibody—associated with the immunoprecipitated member as compared to the positive control, the candidate protein is an antagonist of complex formation.

To determine if a candidate protein inhibits complex formation, a similar experiment is performed, except that the cells expressing Tie1 and Tie2 are treated with the candidate protein prior to treatment of the cells with Ang. The cells are incubated for a period of time sufficient to allow complex formation in the absence of candidate protein. As described above, a positive control in which the cells are not treated with a candidate protein or are treated with a nonspecific protein is performed. The treated cells are then lysed and immunoprecipitations and immunoblots are performed as described above.

Candidate proteins that antagonize complex formation, by inhibiting complex formation or by disrupting complexes, are then tested for their effects on angiogenesis in an assay described herein.

Example 23

Tie2 Amino Acid Sequence

An exemplary Tie2 amino acid sequence is as follows:

```
                                                       (SEQ ID NO: 162)
MDSLASLVLC GVSLLLSGTV EGAMDLILIN SLPLVSDAET SLTCIASGWR     50

PHEPITIGRD FEALMNQHQD PLEVTQDVTR EWAKKVVWKR EKASKINGAY    100
```

```
                         -continued
FCEGRVRGEA IRIRTMKMRQ QASFLPATLT MTVDKGDNVN ISFKKVLIKE    150

EDAVIYKNGS FIHSVPRHEV PDILEVHLPH AQPQDAGVYS ARYIGGNLFT    200

SAFTRLIVRR CEAQKWGPEC NHLCTACMNN GVCHEDTGEC ICPPGFMGRT    250

CEKACELHTF GRTCKERCSG QEGCKSYVFC LPDPYGCSCA TGWKGLQCNE    300

ACHPGFYGPD CKLRCSCNNG EMCDRFQGCL CSPGWQGLQC EREGIPRMTP    350

KIVDLPDHIE VNSGKFNPIC KASGWPLPTN EEMTLVKPDG TVLHPKDFNH    400

TDHFSVAIFT IHRILPPDSG VWVCSVNTVA GMVEKPFNIS VKVLPKPLNA    450

PNVIDTGHNF AVINISSEPY FGDGPIKSKK LLYKPVNHYE AWQHIQVTNE    500

IVTLNYLEPR TEYELCVQLV RRGEGGEGHP GPVRRFTTAS IGLPPPRGLN    550

LLPKSQTTLN LTWQPIFPSS EDDFYVEVER RSVQKSDQQN IKVPGNLTSV    600

LLNNLHPREQ YVVRARVNTK AQGEWSEDLT AWTLSDILPP QPENIKISNI    650

THSSAVISWT ILDGYSISSI TIRYKVQGKN EDQHVDVKIK NATIIQYQLK    700

GLEPETAYQV DIFAENNIGS SNPAFSHELV TLPESQAPAD LGGGKMLLIA    750

ILGSAGMTCL TVLLAFLIIL QLKRANVQRR MAQAFQNVRE EPAVQFNSGT    800

LALNRKVKNN PDPTIYPVLD WNDIKFQDVI GEGNFGQVLK ARIKKDGLRM    850

DAAIKRMKEY ASKDDHRDFA GELEVLCKLG HHPNIINLLG ACEHRGYLYL    900

AIEYAPHGNL LDFLRKSRVL ETDPAFAIAN STASTLSSQQ LLHFAADVAR    950

GMDYLSQKQF IHRDLAARNI LVGENYVAKI ADFGLSRGQE VYVKKTMGRL   1000

PVRWMAIESL NYSVYTTNSD VWSYGVLLWE IVSLGGTPYC GMTCAELYEK   1050

LPQGYRLEKP LNCDDEVYDL MRQCWREKPY ERPSFAQILV SLNRMLEERK   1100

TYVNTTLYEK FTYAGIDCSA EEAA                              1124

SWISS PROT ACCESSION NUMBER: Q02763
```

Example 24

Ang1 Amino Acid Sequence

An exemplary Ang1 amino acid sequence is as follows:

```
                                                    (SEQ ID NO: 163)
   1 MTVFLSFAFL AAILTHIGCS NQRRSPENSG RRYNRIQHGQ CAYTFILPEH DGNCRESTTD

61 QYNTNALQRD APHVEPDFSS QKLQHLEHVM ENYTQWLQKL ENYIVENMKS EMAQIQQNAV

121 QNHTATMLEI GTSLLSQTAE QTRKLTDVET QVLNQTSRLE IQLLENSLST YKLEKQLLQQ

181 TNEILKIHEK NSLLEHKILE MEGKHKEELD TLKEEKENLQ GLVTRQTYII QELEKQLNRA

241 TTNNSVLQKQ QLELMDTVHN LVNLCTKEVL LKGGKREEEK PFRDCADVYQ AGFNKSGIYT

301 IYINNMPEPK KVFCNMDVNG GGWTVIQHRE DGSLDFQRGW KEYKMGFGNP SGEYWLGNEF

361 IFAITSQRQY MLRIELMDWE GNRAYSQYDR FHIGNEKQNY RLYLKGHTGT AGKQSSLILH

421 GADFSTKDAD NDNCMCKCAL MLTGGWWFDA CGPSNLNGMF YTAGQNHGKL NGIKWHYFKG

481 PSYSLRSTTM MIRPLDF

NCBI ACCESSION NUMBER: AAM92271; gi: 22203641
```

Example 25

Conversion of a Mutation Positioned in the Framework 3 Region of Anti-Tie1 E3 Heavy Chain to Germline Residue In order to limit the risk of potential immunogenicity of the E3 antibody after administration to patients, all non-germline mutations in framework regions were corrected back to germline amino acid residues. The anti-Tie1 E03 antibody was isolated from Dyax Fab 200 library. In this library, the HC framework regions are unique and correspond to the DP47 germline segment (V3-23). Since the construction of the synthetic HC-CDR1-CDR2 sublibrary was made through the assembling of overlapping oligonucleotides, followed by some PCR cycles, mutations may have been introduced by one of those 2 steps. Therefore, an analysis was performed which aligned the HC of E03 antibody with the DP47 germline gene sequence. One non-germline mutation positioned in framework region number 3 was identified where a methionine residue has been replaced by a valine residue:

```
                          |                          FR1
1             E   V   Q   L   L   E   S   G   G   G   L   V   Q   P   G   G   S   L   R   L
E03/1         GAAGTTCAATTGTTAGAGTCTGGTGGCGGTCTTGTTCAGCCTGGTGGTTCTTTACGTCTT
              ||  ||  ||  ||||  ||||||||  ||  ||   ||  |||||||||  ||  ||    |  |||
DP47/1        GAGGTGCAGCTGTTGGAGTCTGGGGGAGGCTTGGTACAGCCTGGGGGGTCCCTGAGACTC
1             E   V   Q   L   L   E   S   G   G   G   L   V   Q   P   G   G   S   L   R   L

|      CDR1        |             FR2
21            S   C   A   A   S   G   F   T   F   S   M   Y   G   M   V   W   V   R   Q   A
61            TCTTGCGCTGCTTCCGGATTCACTTTCTCTATGTACGGTATGGTTTGGGTTCGCCAAGCT
              ||  ||  ||  ||  ||  ||||||||  ||      ||  |||      |||||  |||||  |||
61            TCCTGTGCAGCCTCTGGATTCACCTTTAGCAGCTATGCCATGAGCTGGGTCCGCCAGGCT
21            S   C   A   A   S   G   F   T   F   S   S   Y   A   M   S   W   V   R   Q   A

FR2(contd)     |                       CDR2
41            P   G   K   G   L   E   W   V   S   V   I   S   P   S   G   G   N   T   G   Y
121           CCTGGTAAAGGTTTGGAGTGGGTTTCTGTTATCTCTCCTTCTGGTGGCAATACTGGTTAT
              ||  ||  ||  ||   ||||||||||||  ||  ||||   |      ||||||  ||      ||
121           CCAGGGAAGGGGCTGGAGTGGGTCTCAGCTATTAGTGGTAGTGGTGGTAGCACATACTAC
41            P   G   K   G   L   E   W   V   S   V   I   S   P   S   G   G   N   T   G   Y

|           FR3
61            A   D   S   V   K   G   R   F   T   I   S   R   D   N   S   K   N   T   L   Y
181           GCTGACTCCGTTAAAGGTCGCTTCACTATC TCTAGA GACAACTCTAAGAATACTCTCTAC
              ||   ||||||||  ||  ||  ||  ||||  ||||||     |||||  ||  ||  |||  ||  ||
181           GCAGACTCCGTGAAGGGCCGGTTCACCATCTCCAGAGACAATTCCAAGAACACGCTGTAT
61            A   D   S   V   K   G   R   F   T   I   S   R   D   N   S   K   N   T   L   Y

FR3                                    |
81            L   Q   V   N   S   L   R   A   E   D   T   A   V   Y   Y   C   A   R   A   P
241           TTGCAGGTGAACAGCTTAAGGGCTGAGGACACTGCAGTCTACTATTGTGCGAGAGCCCCA
              ||||   ||||||||||  |   ||  ||  |||||||||  ||  ||  ||  ||||||||  ||
241           CTGCAAATGAACAGCCTGAGAGCCGAGGACACGCCGTATATTACTGTGCGAAAGA              (SEQ ID NO: 720)
81            L   Q   M   N   S   L   R   A   E   D   T   A   V   Y   Y   C   A   K         (SEQ ID NO: 721)

CDR3                              |       FR4
301           CGTGGATACAGCTATGGTTACTACTACTGGGGCCAGGGAACCCT GGTCACC GTCTCAAGC
101           R   G   Y   S   Y   G   Y   Y   Y   W   G   Q   G   T   L   V   T   V   S   S

361           GCCTCCACCAAGGGCCCATCGGTCTTCCCCCTGGCACCCTCCTCC
121           A   S   T   K   G   P   S   V   F   P   L   A   P   S   S
```

(An exemplary TIE1-E3 HC variable region sequence compared to germline segment DP47. Non germline framework mutation appears in bold. The italicized motif corresponds to the XbaI restriction site while the italicized and bolded motif corresponds to BstEII restriction site. The TIE1-E3 HC variable region sequences correspond to nucleotides 1 to 405 of SEQ ID NO:113 and to amino acids 1 to 135 of SEQ ID NO:114.)

A strategy was then designed to repair this mutation. The introduction of the germlined residue was facilitated by the presence of internal restriction sites in the framework flanking regions of the CDRs. Indeed, the design of the HC-CDR1-CDR2 sublibrary, present in FAB 310 library, was made in such a way that the shuffling of every CDR is allowed by the presence of unique restriction sites in the framework flanking regions. Since the valine residue to be corrected is located in FR3 region, 3' near the XbaI site, a primer was designed containing both the XbaI sequence and the corrected methionine germline residue. The changes were introduced by PCR using the Top XbaI-M forward primer combined with a 3' reverse primer (CJ-lift Nhe REV) annealing in the CH1 region. A PCR fragment of ~180 bp was then generated. The germlining PCR primers were:

```
Top XbaI -M primer:
5' TTCACTATCTCTAGAGACAACTCTAAGAATACTCTCTACTTGCAGaTGAAC 3'   (SEQ ID NO: 717)
    F   T   I   S   R   D   N   S   K   N   T   L   Y   L   Q   M   N         (SEQ ID NO: 718)

CJ-1ift Nhe REV:
5' GGAGGGTGCTAGCGGGAAGACCG 3'                                (SEQ ID NO: 719)
```

Example 26

Cloning of Germlined Heavy Chain TIE1 E03 (E3b) into Bacterial Phagemid Vectors (pMID1) for Soluble Fab Production In order to determine if the germlined residue introduced into E03 heavy chain had affected the biological activity of the antibody, a soluble Fab expression vector containing the germlined E03 antibody ("E3b") was constructed. The PCR fragment from example 25 was digested overnight with 50 U/µg XbaI restriction enzyme, followed by a 5 hours digestion with 25 U/µg BstEII. The cleaved PCR product was then purified on a 1% TAE-agarose preparative gel. Ligation into the similarly-digested phagemid expression vector (pMID1) containing the TIE1 E03 germlined light chain sequence was performed for three hours at room temperature. Five nanograms of the newly-ligated material were electroporated into TG1 bacterial cells. Verification of the correction of the mutation was performed by sequence determination of the heavy chain of 20 randomly picked isolates. The resulting coding construct contained sequences that encode a germlined HC and a germlined LC sequence in a Fab format (termed Fab E3b).

Example 27

Production and Purification of E3b

The E3b Fab antibody was reformatted to a human IgG1. This construct was then used to transiently transfect HEK293T cells. Plasmid preparations for transient cell transfections were obtained using the Qiagen filter Plasmid Maxi kit (Qiagen, cat. no. 12263). HEK293T cells (GenHunter Corp., cat. no. Q401) were seeded 24 hours before transfection; $220 \times 10^6$ cells were plated per CELLSTACK® culture vessel (CellSTACK®-10 Chamber, Corning, cat. no. 3271). Transfections were carried out using the GeneJuice® reagent (VWR, cat. no. novg70967-3) following the manufacturer's instructions. 650 micrograms of plasmid DNA was used per CELLSTACK®. Cells were cultured in DMEM (Invitrogen, cat. no. 31966021) supplemented with 10% "ultra-low IgG" fetal calf serum (Invitrogen, cat. no. 16250078), at 37° C., 5% $CO_2$, in a water saturated atmosphere. Conditioned media were harvested 72, 144 and 216 hours after transfection, pooled and sterile filtered.

Cell culture supernatants were loaded on a 25-ml rProteinA FF column (GE Healthcare, cat. no. 17-1279-02) equilibrated against PBS containing 0.5 M NaCl. The column was washed with PBS containing 0.5 M NaCl, then with 0.1 M sodium acetate pH 5.0 to remove bovine IgGs and the antibody was eluted with 12.5 mM citric acid. Fractions (5 ml) containing the antibody were neutralized by addition of 150 µl of 1 M Tris-HCl, pH 9.0.

The E3b antibody was further purified by cation exchange. The antibody was dialyzed against 50 mM sodium citrate, pH 5.0, and loaded on a HiLoad 26/10 SP Sepharose HP column (GE Healthcare, cat. no. 17-1138-01) equilibrated in the same buffer. The antibody was eluted with 50 mM sodium citrate, pH 5.0, containing 1 M NaCl (linear gradient on 10 column volumes). Fractions containing the antibody were pooled and dialyzed against PBS. Antibody concentration was calculated from the absorbance at 280 nm, assuming that a protein concentration of 1 mg/ml has an absorbance of 1.36.

Example 28

Testing of E3b-IgG1 Binding to TIE-1/Fc in BIAcore

The germlined E3b IgG1 stock solution (0.56 mg/ml) and the parental E3 IgG1 stock solution (0.41 mg/ml) were diluted 50-fold in 10 mM sodium acetate, pH 4.5. The IgGs were directly coated on a CM5 chip. The surface of the chip was activated with a 7-minute pulse of 0.05 M NHS/0.2 M EDC and the IgG was run over the chip until 823 RU of germlined E3b and 788 RU of parental E3 were coated on the surface. All flow cells were subsequently deactivated with a 7-minute pulse of 1 M ethanolamine hydrochloride, pH 8.5. All further experiments were performed in HBS buffer.

Purified recombinant human Tie-1/Fc was diluted in HBS to final concentrations of 200, 100, 50, 25 and 12.5 nM. Samples were injected at 30 µl/min for 8.3 minutes using the kinject program. This was followed by a 50-minute dissociation phase. Any remaining antigen was stripped from the surface with two 30-sec injections of 10 mM glycine, pH 1.5.

The sensorgrams obtained with this approach are shown below. Visual analysis shows that the dissociation ($k_{off}$) is extremely slow (only a very small fraction of Tie-1/Fc dissociated despite the long dissociation time), which suggests a very tight interaction. Interestingly, the dissociation rates for the IgGs as measured here are much slower that those of the corresponding Fabs (see Example 29 below), indicating that there is a significant increase in the affinity when going from the monovalent Fab to the bivalent IgG (avidity).

Example 29

Testing of E3b-Fab Binding to TIE-1/Fc in BIAcore

In order to evaluate if the binding behaviour had been affected in any way by the conversion of the somatic mutations back to germline residues, the parental and the germlined E3b antibodies were produced and tested in Biacore as Fab fragments. Here, by contrast to what was done for the IgGs (see. Example 28), and in order to measure a monovalent interaction, the Fabs were run over the antigen directly coated onto the surface.

Recombinant human Tie-1/Fc was coated on a CM5 chip. The surface of the chip was first activated with a 7-minute pulse of 0.05 M NHS/0.2 M EDC, then Tie-1/Fc (2 µg/ml in 10 mM sodium acetate, pH 4.0) was run over the chip surface until 750 RUs were coated on the surface. All flow cells were subsequently deactivated with a 7-minute pulse of 1 M ethanolamine hydrochloride, pH 8.5. All further experiments were performed in HBS buffer.

The parental and the germlined E3b Fabs were prepared. A series of dilution (50, 25, 12.5, 6.25 and 3.125 nM) was prepared in HBS buffer. Samples were injected at 30 μl/min for 5.3 minutes using the KINJECT™ program. This was followed by a 10-minute dissociation phase, and the remaining Fab was stripped from the surface with a single 18-sec injection of 50 mM NaOH/1 M NaCl.

Sensorgrams were analyzed using the simultaneous ka/kd fitting program from the BIAEVALUATION™ software 3.1 assuming a 1:1 model. This analysis proved that the germlining of the E3 antibody has little or no effect on the affinity against Tie-1/Fc

| E3 Fab | Tie-1 Fc | ka (1/Ms) | kd (1/s) | KD(nM) |
|---|---|---|---|---|
| Parental | Human | 8.81e4 | 1.05e−03 | 12 |
| germlined (E3b) | Human | 1.36e5 | 1.01e−03 | 7 |

Example 30

Testing of E3b-IgG for Biological Activity in Tube Formation Assays

Figure 4:
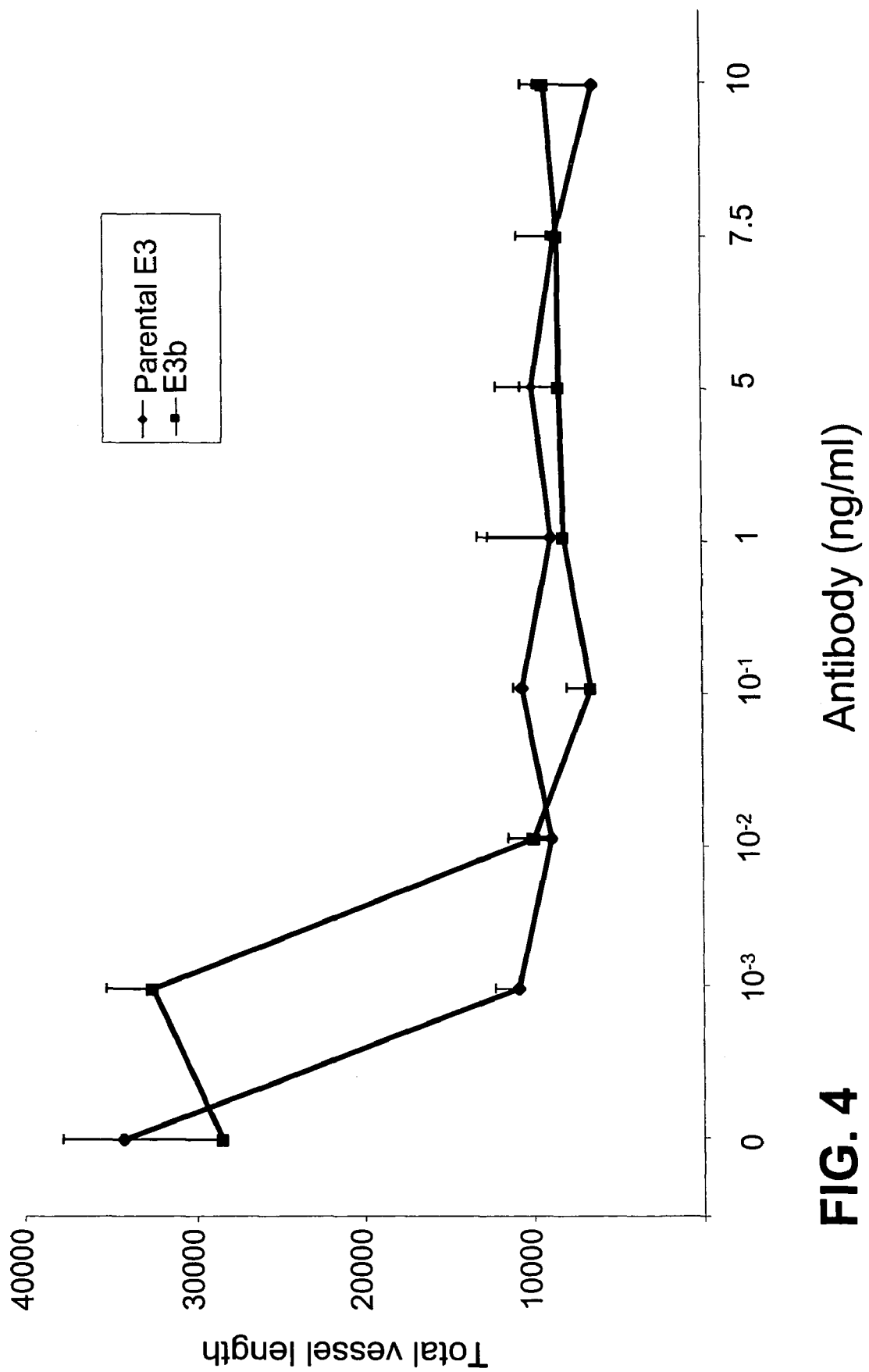
FIG. 4 depicts results of tube formation in HUVECs using the parental E3 and E3b (germlined) proteins.
Figure 5:
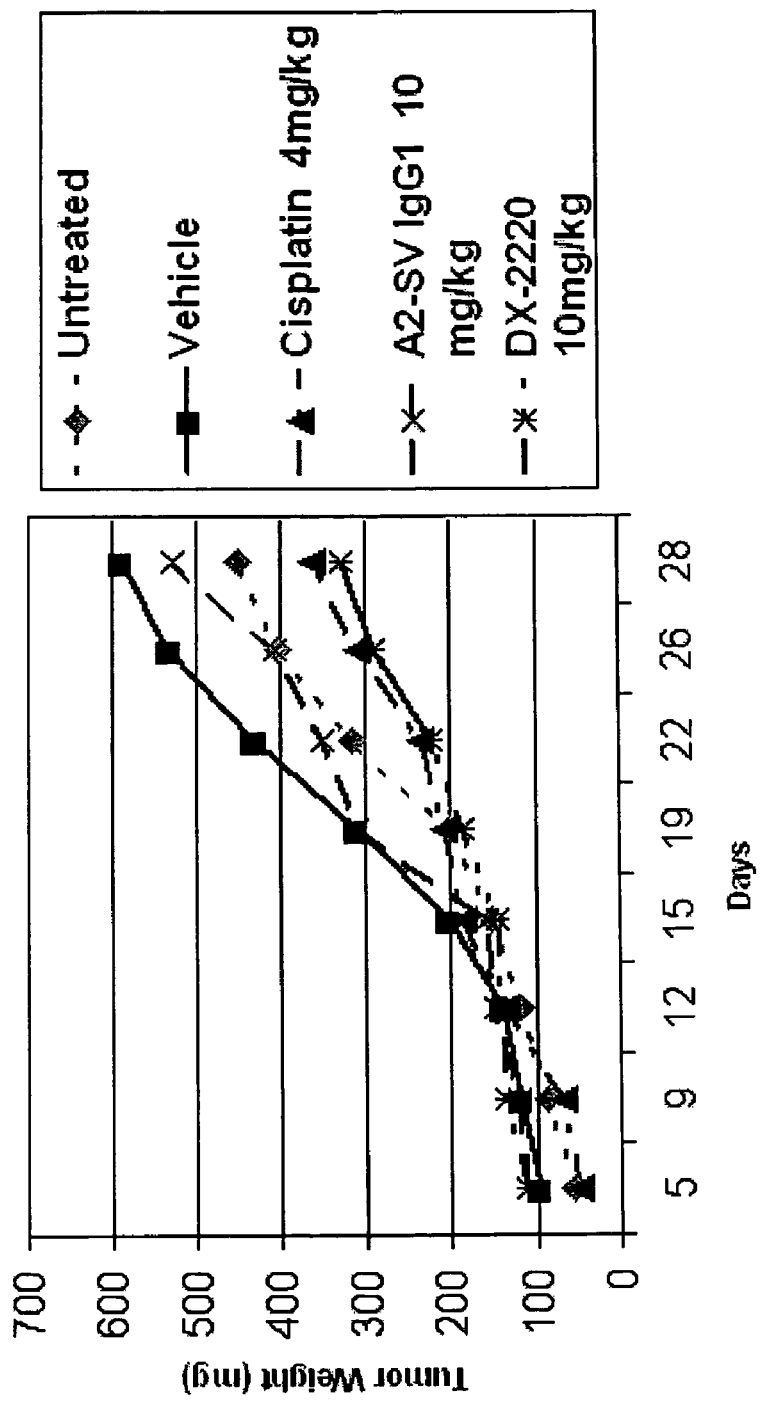
FIG. 5 depicts graphically the results from animal studies in which nu/nu mice were implanted with SW-480 colorectal cancer cells and treated with DX-2220 (10 mg/kg), cisplatin (4 mg/kg), or a control. Control conditions were: no treatment, PBS vehicle alone, or a non-specific, isotype-matched IgG1 antibody (A2-SV) (10 mg/kg). Tumor weight is plotted on the y axis; days after tumor cell injection is plotted on the x axis.

The purpose of this study was to determine if the correction of HC mutation back to germline in the parental E3 has any effect on the biological activity. Human umbilical vein endothelial cells (HUVEC) (freshly isolated) were obtained by treating human umbilical cord veins with Trypsin-EDTA (1×) (Gibco/Invitrogen) for 20-25 minutes at 37° C. The cells were then cultured in a T-25 flask coated with attachment factor (AF), (Cascade Biologics) in RPMI 1640 medium supplemented with 10% FCS, 0.4% BBE, 1% l-glutamin, 1% penicillin/streptomycin. Primary cultures were detached with warm Trypsin-EDTA and used when confluent at the second or third passage. During culturing, the cells were kept in a proliferative state by culturing them in a split ratio 1:2 at an approximate density of the monolayer of about 60-80%. HUVEC monolayers were treated with trypsin/EDTA (500 μl/dish) at 37° C. for 3 min. Trypsin activity was stopped by adding 3 volumes of complete RPMI medium. The cells were carefully scraped, separated by repeated pipetting, and finally washed with PBS. HUVECs (passage 3) were seeded in their culture medium (40×10³/50 μl/well of a 96-well plate) on a collagen gel (50 μl of collagen I 1.5 mg/ml) prepared by mixing 7.5 volumes of 2 mg/ml collagen (Collagen R; Serva, Heidelberg, Germany), 1 volume of 10×MEM, 1.5 volume of NaHCO₃ (15.6 mg/ml) and ~1 volume of NaOH to adjust the pH to 7.4. After 1 h 30 min, the culture medium was then discarded and the cells were covered with a new layer of collagen (1.5 mg/ml, new preparation, 50 μl/well). After polymerization of the gel, culture medium was added to each well in presence or in absence of E3b-IgG1 or parental E3 antibody (1 pg/ml to 10 ng/ml). Endothelial tube formation was assessed with an inverted photomicroscope. Microphotographs of the centre of each well at low power (×40) were taken with a Nikon camera with the aid of imaging-capture software. Tube formation in the microphotographs was quantitatively analysed (total tube length) with METAVUE® software (FIGS. 4 and 5). Tube formation by untreated HUVECs in full endothelial cell growth medium was used as control. Results from triplicate wells were expressed as mean vessel area per field ±SEM (relative units) (FIG. 6). The conclusions are that E3b-IgG1 inhibits tube formation. Correction of HC mutation had no significant effect on biological activity.

Example 31

Exemplary Tie-1 Binding Sequences

The following are exemplary sequences of immunoglobulin light chain and heavy chain variable domains:

```
1. 806C-M0044-A06
L-Variable (AA):
                                          (SEQ ID NO: 164)
QSELTQPPSASGTPGQRVTISCSGSSSSIGLNPVNWYQQLPGTAPKVVIH
SNDQRPSGVPDRFSGSKSGTSASLAISGLQSEDEADYYCAAWDDSLNGPA
FGGGTKLTVL L-Variable (DNA):
                                          (SEQ ID NO: 165)
CAGAGCGAATTGACTCAGCCACCCTCAGCGTCTGCGACCCCCGGGCAGAG
GGTCACCATCTCTTGTTCTGGAAGCAGCTCCAGCATCGGACTTAATCCTG
TAAACTGGTACCAGCAGCTCCCAGGAACGGCCCCCAAAGTAGTCATCCAT
AGTAATGATCAGCGGCCCTCAGGGGTCCCTGACCGATTCTCTGGCTCCAA
GTCTGGCACCTCAGCCTCCCTGGCCATCAGTGGACTCCAGTCTGAGGATG
AGGCTGATTATTACTGTGCAGCATGGATGACAGCCTGAATGGTCCCGCA
TTCGGCGGAGGGACCAAGCTGACCGTCCTAG H-Variable (AA):
                                          (SEQ ID NO: 166)
EVQLLESGGGLVQPGGSLRLSCAASGFTFSSYVMMWVRQAPGKCLEWVSR
IYPSGGITQYADSVKGRFTISRDNSKNTLYLQMNSLRAEDTAVYYCARDV
YRAFDIWCQGTMVTVSS H-Variable (DNA):
                                          (SEQ ID NO: 167)
GAAGTTCAATTGTTAGAGTCTGCTGGCGGTCTTGTTCAGCCTGGTGGTTC
TTTACGTCTTTCTTGCGCTGCTTCCGGATTCACTTTCTCTTCTTACGTTA
TGATGTGGGTTCGCCAAGCTCCTGGTAAAGGTTTGGAGTGCGTTTCTCGT
ATCTATCCTTCTGGTGGCATTACTCAGTATGCTGACTCCGTTAAACGTCC
CTTCACTATCTCTAGAGACAACTCTAAGAATACTCTCTACTTGCAGATGA
ACAGCTTAAGGGCTGAGGACACGGCCGTGTATTACTGTGCAAGAGATGTC
TACAGGGCTTTTGATATCTGGGGCCAAGGGACAATGGTCACCGTCTCAAG
C
2. 806C-M0044-A11
L-Variable (AA):
                                          (SEQ ID NO: 168)
QDIQMTQSPGTLSLSPGERATLSCRASQSVSSSYLAWYQQKPGQAPRLLI
YGASSRATGIPDRFSGSCSGTDFTLTISRLEPEDFAVYYCQQYGSSPPGG
TFGQGTKVEIK L-Variable (DNA):
                                          (SEQ ID NO: 169)
CAAGACATCCAGATCACCCAGTCTCCAGGCACCCTGTCTTTGTCTCCAGG
GGAAAGAGCCACCCTCTCCTGCAGGGCCAGTCAGAGTGTTAGCAGCAGCT
ACTTAGCCTGGTACCAGCAGAAACCTGGCCAGGCTCCCAGGCTCCTCATC
TATGGTGCATCCAGCAGGGCCACTGGCATCCCAGACAGGTTCAGTGGCAG
TGGGTCTGGGACAGACTTCACTCTCACCATCAGCAGACTGGAGCCTGAAG
ATTTTGCAGTGTATTACTGTCAGCAGTATGGTAGCTCACCTCCCGGGGGA
ACGTTCGGCCAAGGGACCAAGGTGGAAATCAAA H-Variable (AA):
                                          (SEQ ID NO: 170)
EVQLLESGGGLVQPGGSLRLSCAASGFTFSSYKMHWVRQAPGKGLEWVSS
IYPSGGYTYYADSVKGRETISRDNSKNTLYLQNNSLRAEDTAVYYCARDS
HHFHFWGDYYFLEYWGQGTLVTVSS H-Variable (DNA):
                                          (SEQ ID NO: 171)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACAAGA
TGCATTCGGTTCGCCAAGCTCCTGGTAAAGGTTTGGAGTGGGTTTCTTCT
ATCTATCCTTCTGGTGGCTATACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTATATTACTGTGCGAGAGATAGC
CATCATTTCCATTTTTGGGGTGACTATTATTTTCTAGAATACTGGGGCCA
GGGAACCCTGGTCACCGTCTCAAGC
```

-continued 3. 806C-M0044-B04
L-Variable (AA):
(SEQ ID NO: 172)
QDIQMTQSPSSLSASVGDRVTITCRASQSISSYLNWYQQKPGKAPKLLIY
AASSLQSGVPSRFSGSCSGTDFTLTISSLQPEDFATYYCQQSYSTPPTFG
GGTKVEIK L-Variable (DNA):
(SEQ ID NO: 173)
CAAGACATCCAGATGACCCAGTCTCCATCCTCCCTGTCTGCATCTGTAGG
AGACAGAGTCACCATCACTTGCCGGGCAAGTCAGAGCATTAGCAGCTATT
TAAATTGGTATCAGCAGAAACCAGGGAAAGCCCCTAAGCTCCTGATCTAT
GCTGCATCCAGTTTGCAAAGTGGGGTCCCATCAAGGTTCAGTGGCAGTGG
ATCTGGGACAGATTTCACTCTCACCATCAGCAGTCTGCAACCTGAAGATT
TTGCAACTTACTACTGTCAACAGAGTTACAGTACCCCTCCCACTTTCGGC
GCAGGGACCAAGGTGGACATCAAA H-Variable (AA):
(SEQ ID NO: 174)
EVQLLESGGGLVQPGGSLRLSCAASGFTFSQYLMFWVRQAPCKCLEWVSY
IYPSGGWTMYADSVKGRFTISRDNSKNTLYLQMMSLRAEDTAVYYCARQN
YYDSSGYYYRGFDYWGQGTLVTVSS H-Variable (DNA):
(SEQ ID NO: 175)
GAAGTTCAATTGTTAGACTCTGGTGGCGGTCTTGTTCAGCCTGGTGGTTC
TTTACGTCTTTCTTGCGCTGCTTCCGGATTCACTTTCTCTCAGTACCTTA
TGTTTTGGGTTCGCCAAGCTCCTGGTAAAGGTTTGGAGTGGGTTTCTTAT
ATCTATCCTTCTGGTGGCTGGACTATGTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGGCAAAAT
TACTATGATAGTAGTGGTTATTACTATCGTGGCTTTGACTACTGGGGCCA
GGGAACCCTGGTCACCGTCTCAAGC 4. 806C-M0044-B05
L-Variable (AA):
(SEQ ID NO: 176)
DIHMTQSPATLSLSPGERATLSCRASQSVSSYLAWYQQKPGQAPRLLIYD
ASNRATGIPARFSGSGSGTDFTLTISSLEPEDFAVYYCQQRSNWPPGITF
GGGTKVEIK L-Variable (DNA):
(SEQ ID NO: 177)
GACATCCATATGACCCAGTCTCCAGCCACCCTGTCTTTGTCTCCAGGGGA
AAGAGCCACCCTCTCCTGCAGGGCCAGTCAGAGTGTTAGCAGCTACTTAG
CCTGGTACCAACAGAAACCTGGCCAGGCTCCCAGGCTCCTCATCTATGAT
GCATCCAACAGGGCCACTGGCATCCCAGCCAGGTTCAGTGGCAGTGGGTC
TGGGACAGACTTCACTCTCACCATCAGCAGCTAGAGCCTGAAGATTTTG
CAGTTTATTACTGTCAGCAGCGTAGCAACTGGCCTCCGGGGATCACTTTC
GGCGGAGCGACCAAGGTGGAGATCAAA H-Variable (AA):
(SEQ ID NO: 178)
EVQLLESGGGLVQPGGSLRLSCAASGFTFSSYKMGWVRQAPGKGLEWVSS
IYPSGGWTHYADSVKGRFTISRNSKNTLYLQMNSLRAEDTAXTYYCARVL
LHYFDYWGQGTLVTVSS H-Variable (DNA):
(SEQ ID NO: 179)
GAAGTTCAATTGTTAGAGTCTGGTGGCGGTCTTGTTCAGCCTGGTGGTTC
TTTACGTCTTTCTTCCGCTGCTTCCGGATTCACTTTCTCTTCTTACAAGA
TGGGTTGGGTTCGCCAAGCTCCTGGTAAAGGTTTGGAGTGGGTTTCTTCT
ATCTATCCTTCTGGTGGCTGGACTCATTATGCTGACTCCGTTAAAGGTCC
CTTCACTATCTCTAGAGACAACTCTAAGAATACTCTCTACTTGCAGATGA
ACAGCTTAAGGGCTGAGGACACTGCAGTCTACTATTGTCAAGAGTACTA
CTACACTACTTTGACTACTGGGGCCAGGGAACCCTGGTCACCGTCTCAAG
C 5. 806C-M0044-B08
L-Variable (AA):
(SEQ ID NO: 180)
QDIQNTQSPSFLSASVGDRVTISCPASQYISIYLNWYQQRPGEAPKLLIN
AASSLQSGDPSRFSGSGSGTDFTLTINSLQPDDFATYYCQQYKSYPLTFG
EGTKVEIK L-Variable (DNA):
(SEQ ID NO: 181)
CAAGACATCCAGATGACCCAGTCTCCATCCTTCCTGTCCGCATCTGTAGG
AGACAGAGTCACCATCTCTTGCCGGGCAAGTCAGTACATCAGCATATATT
TGAATTGGTATCAGCAGAGACCACGGGAAGCCCCTAAACTCCTGATCAAT
GCTGCATCCAGTTTGCAAAGTGGGGACCCATCAAGGTTCAGTGGCAGTGC
ATCGGGACAGATTTCACTCTCACCATCAACAGCCTGCAGCCTGATGATT
TTGCAACTTATTACTGCCAACAGTATAAGAGTTACCCCCTCACTTTCGGC
GAGGGGACCAAGGTGGAGATCAAA H-Variable (AA):
(SEQ ID NO: 182)
EVQLLESGGGLVQPGGSLRLSCAASGFTFSAYGMGWVRQAPCKGLEWVSV
ISPSGGQTSYADSVKGRFTISRDNSKNTLYLQMNSLRAEDTALYYCAGGD
RYGPLHYWGQGTLVTVSS H-Variable (DNA):
(SEQ ID NO: 183)
GAACTTCAATTGTTAGAGTCTGCTGGCGCTCTTGTTCAGCCTGGTGGTTC
TTTACGTCTTTCTTGCGCTGCTTCCGGATTCACTTTCTCTGCTTACGGTA
TGGGTTGGCTTCGCCAAGCTCCTGGTAAAGGTTTGGAGTGGGTTTCTGTT
ATCTCTCCTTCTGGTGGCCAGACTTCTTATGCTGACTCCGTTAAAGGTCG
CTTCACTATCTCTAGAGACAACTCTAAGAATACTCTCTACTTGCAGATGA
ACAGCTTAAGGCCTGAGGACACCGCCTTGTATTACTGTGCGGGAGGGGAC
AGGTATGGACCCTTGCACTACTGGGGCCAGGGAACCCTGGTCACCGTCTC
AAGC 6. 806C-M0044-B09
L-Variable (AA):
(SEQ ID NO: 184)
QDIQMTQSPSSLSASVGDRVTITCQASQDISNYLNWYQQKPGKAPKLLIY
HASNLETGVPSRFSGSGSGTDFTLTISSLQPEDFATYYCLQYKSYPRLFG
QCTKVEVK L-Variable (DNA):
(SEQ ID NO: 185)
CAAGACATCCAGATGACCCAGTCTCCATCCTCCCTGTCTGCATCTGTAGG
AGACAGAGTCACCATCACTTGCCAGGCGAGTCAGGACATTAGCAACTATT
TAAATTGGTATCAGCAGAAACCCCCCTAAGCTCCTGATCTAC
CATGCATCCAATTTGGAAACAGGGGTCCCATCAAGGTTCAGTCAACTGG
ATCTGGGACAGATTTCACTCTCACCATCAGCAGTCTGCAACCTGAAGATT
TTGCAACTTATTACTGTCTTCAGTATAAAAGTTACCCTGATTGTTCGGC
CAAGGGACCAAGGTGGAAGTCAAA H-Variable (AA):
(SEQ ID NO: 186)
EVQLLESGGGLVQPGGSLRLSCAASGFTFSNYKMNWVRQAPGKGLEWVSV
IYPSGGWTYYADSVKGRFTISRNSKNTLYLQMNSLRAEDTAVYYCASGYY
DSSGYSRFDYWGQGTLVTVSS H-Variable (DNA):
(SEQ ID NO: 187)
GAAGTTCAATTGTTAGAGTCTGGTGGCGGTCTTGTTCAGCCTGGTGGTTC
TTTACGTCTTTCTTGCGCTGCTTCCGGATTCACTTTCTCTAATTACAAGA
TGAATTGGGTTCGCCAAGCTCCTGGTAAAGGTTTGGAGTGGGTTTCTGTT
ATCTATCCTTCTGGTGGCTGGACTTATTATGCTGACTCCGTTAAAGGTCG
CTTCACTATCTCTAGAGACAACTCTAAGAATACTCTCTACTTGCAGATCA
ACAGCTTAAGGGCTGAGGACACGGCTGTGTATTACTGTGCGAGTGGTTAC
TATGATAGTAGTGGTTACTCCCGATTTGACTACTGGGGCCAGGGAACCCT
GGTCACCGTCTCAAGC 7. 806C-M0044-B10
L-Variable (AA):
(SEQ ID NO: 188)
QSALTQPASVSGSPGQSITISCTGTSSDVGSYNLVSWYQQHPGKAPQLMT
YEGSKRPSGLSNRFSGSKSDNTASLTISGLQAEDEADYYCCSYAGSSTLV
FGGGTKLTVL L-Variable (DNA):
(SEQ ID NO: 189)
CAGAGCGCTTTGACTCAGCCTGCCTCCGTGTCTGGGTCTCCTGGACAGTC
GATCACCATCTCCTGCACTGGAACCAGCAGTGATGTTGGGAGTTATAACC
TTGTCTCCTGGTACCAACAACACCCAGGCAAAGCCCCCCAACTCATGATT
TATGAGGGCAGTAAGCGGCCCTCAGGACTTTCTAATCGCTTCTCTGGCTC
CAAGTCTGACAACACGGCCTCCCTGACAATCTCTGGGCTCCAGGCTGAGG
ACGAGGCTGATTATTACTGCTGCTCATATGCAGGTAGTAGCACTTTAGTA
TTCGGCGGAGGGACCAAGCTGACCGTCCTA H-Variable (AA):
(SEQ ID NO: 190)
EVQLLESGGGLVQPGGSLRLSCAASGFTFSRYKNGWVRQAPGKGLEWVSS
IYPSGGPTYYADSVKGRFTISRDNSKNTLYLQMNSLRAEDTAMYYCARSE
VGAPDYWGQGTLVTVSS -continued H-Variable (DNA):
(SEQ ID NO: 191)
GAACTTCAATTGTTAGAGTCTGGTGGCGGTCTTGTTCAGCCTGGTGGTTC
TTTACGTCTTTCTTGCGCTGCTTCCGGATTCACTTTCTCTCGTTACAAGA
TGGGTTGGGTTCGCCAAGCTCCTGGTAAAGGTTTGGAGTGGGTTTCTTCT
ATCTATCCTTCTGGTGGCCTACTTATTATGTGACTCCGTTAAAGGTCG
CTTCACTATCTCTAGAGACAACTCTAAGAATACTCTCTACTTGCAGATGA
ACAGCTTAAGGGCTGAGGACACAGCCATGTATTACTGTGCGAGAAGCGAA
GTGGGAGCCCCCGACTACTGGGGCCAGGGAACCCTGGTCACCGTCTCAAG
C 8. 806C-M0044-B12
L-Variable (AA):
(SEQ ID NO: 192)
QDIQMTQSPSTLSASVGDTVTMTCRASQSISGWLAWYQQKPGKAPNLLIF
KASTLKSGVPSRFRGSGSGTEFTLTISSLQPDDFATYYCQQYNSYSQTFG
QGTKVEIK L-Variable (DNA):
(SEQ ID NO: 193)
CAAGACATCCAGATGACCCAGTCTCCTTCCACCCTTTCTGCATCTGTAGG
AGACACCGTCACCATGACTTGCCGGGCCAGTCAGAGTATTACTGCGTGGT
TGGCCTGGTATCAGCAGAAACCAGGGAAAGCCCCTAACCTCCTGATCTTT
AACGCGTCTACTTTAAAAAGTGGGGTCCCGTCAAGGTTTCGCGGCAGTGG
ATCTGGGACAGAATTCACTCTCACCATCAGCAGCCTGCAGCCTGATGATT
TTGCAACTTATTACTGCCAACAATATAATAGTTATTCTCAGACGTTCGGC
CAAGGGACCAAGGTGGAAATCAAA H-Variable (AA):
(SEQ ID NO: 194)
EVQLLESGGGLVQPGGSLRLSCAASGFTFSMYKNHWVRQAPGKGLEWVSS
IYPSGGYTVYADSVKGRFTISRDNSKNTLYLQMNSLRAEDTAVYYCATDR
WSSGCYGVDFWGQGTLVTVSS H-Variable (DNA):
(SEQ ID NO: 195)
GAAGTTCAATTGTTAGAGTCTGGTGGCGGTCTTGTTCAGCCTGGTGGTTC
TTTACGTCTTTCTTGCGCTGCTTCCGGATTCACTTTCTCTATGTACAAGA
TGCATTGGGTTCGCCAAGCTCCTGGTAAAGGTTTGGAGTGGGTTTCTTCT
ATCTATCCTTCTGGTGGCTATACTGTTTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCCACAGACCGG
TGGAGCAGTGGCGGGTACGGTGTTGACTTCTGGGGCCAGGGAACCCTGGT
CACCGTCTCAAGC 9. 806C-M0044-C07
L-Variable (AA):
(SEQ ID NO: 196)
QDIQMTQSPLSLPVTPGEPASISCRSSQSLLHSNGYNYLDWYLQKPGQSP
QLLIYLGSNRASGVPDRFSGSGSGTDFTLKISRVEAEDVGVYYCMQALQT
PQFGQGTKVEIK L-Variable (DNA):
(SEQ ID NO: 197)
CAAGACATCCAGATGACCCAGTCTCCACTCTCCCTGCCCGTCACCCCTGG
AGAGCCGGCCTCCATCTCCTGCAGGTCTAGTCAGAGCCTCCTGCATAGTA
ATGGATACAACTATTTGGATTGGTACCTGCAGAAGCCAGGGCAGTCTCCA
CAGCTCCTGATCTATTTGGGTTCTAATCGGGCCTCCGGGGTCCCTGACAG
GTTCAGTGGCAGTGCATCAGGCACAGATTTTACACTGAAAATCAGCAGAG
TGGAGGCTGAGGATGTTGGGGTTTATTACTGCATGCAAGCTCTACAAACT
CCTCAGTTCGGCCAAGGGACCAAGGTGGAAATCAAG H-Variable (AA):
(SEQ ID NO: 198)
EVQLLESGGGLVQPGGSLRLSCAASGFTFSHYDMSWVRQAPGKGLEWVSY
IYPSGGPTYYADSVKGRFTISRDNSKNTLYLQNNSLRAEDTAVYYCARGD
WASRFATWGQGTTVTVSS H-Variable (DNA):
(SEQ ID NO: 199)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCATTACGATA
TGTCTTGGGTTCGCCAAGCTCCTGGTAAAGGTTTGGAGTGGGTTTCTTAT
ATCTATCCTTCTGGTGGCCCTACTTATTATCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCAAGAGGCGAT
TGGGCTTCTCGTTTTGCCACCTGGGGCCAGGGGACCACGGTCACCGTCTC
AAGC 10. 806C-M0044-D01
L-Variable (AA):
(SEQ ID NO: 200)
QYELTQPPSVSVAPGQTARTTCGGNNIGIKSVNWYQQKPGQAPVLVVYDD
SGRPSGIPQRFSGSNSGNTATLTINRVEAGDEADYYCQVWDSGSDHWVFG
GGTKLTVL L-Variable (DNA):
(SEQ ID NO: 201)
CAGTACGAATTGACTCAGCCACCCTCGGTGTCACTGGCCCCAGGACAGAC
GGCCAGGATTACCTGTGGGGGAAACAACATTGGAATTAAAACTGTGAACT
GGTACCAGCAGAAGCCAGGCCAGGCCCCTGTGCTGGTCGTCTATGATGAT
AGTGGCCGGCCCTCAGGCATCCCTCAGCGATTCTCTGGCTCCAACTCTGG
GAACACGGCCACCCTGACCATCAACAGGGTCGAAGCCGGGGATGAGGCCG
ACTATTACTGTCAGGTGTGGGATAGTGGTAGTGATCATTGGGTGTTCGGC
GGAGGGACCAACCTGACCGTCCTA H-Variable (AA):
(SEQ ID NO: 202)
EVQLLESGGGLVQPGGSLRLSCAASGFTFSHYKNGWVRQAPGKGLEWVSS
IYPSGCFTRYAIJSVKGRFTISRDNSKNTLYLQMNSLRAEDTAVYYCARN
FVESSRYYHDYWGQGTLVTVSS H-Variable (DNA):
(SEQ ID NO: 203)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCATTACAAGA
TGGCTTGGGTTCGCCAAGCTCCTGGTAAAGCTTTGGAGTGGGTTCTTCT
ATCTATCCTTCTGGTGCTTTACTCGTTATGCTGACTCCGTTAAAGGTCG
CTTCACTATCTCTAGAGACAACTCTAACAATACTCTCTACTTGCAGATCA
ACAGCTTAAGGGCTGACGACACGGCCGTGTATTACTCTGCCAGAAATTTC
GTTGAAAGTAGTCATTATTACCATGACTATTGGGGCCAGGGAACCCTGGT
CACCGTCTCAAGC 11. 806C-M0044-E03
L-Variable (AA):
(SEQ ID NO: 204)
QSELTQPPSVSVAPGQTAVITCGGSNIGGKSVHWYQQKSGQAPVLVVFDD
RDRPSGIPERFSGSNSGNTATLTITRVEVGDEADYYCQVWDSGTDHRVFG
GGTRLTAL L-Variable (DNA):
(SEQ ID NO: 205)
CAGACCGAATTGACTCAGCCACCCTCGGTCTCAGTGGCCCCAGGGCAGAC
GGCCGTGATTACCTGTGGGGGGAGCAACATTGGAGGTAAAAGTGTACACT
GGTACCAGCAGAAGTCAGGCCAGGCCCCTGTGCTGGTCGTCTTTGATGAT
CGCGACCGGCCCTCAGGGATCCCTGAGCGATTCTCTGGCTCCAACTCCGG
GAACACGGCCACCCTGACCATCACCAGGGTCGAAGTCGGGGATGACGCCG
ACTATTACTGTCAGGTGTGGGATAGTGGAACTGATCATCGGGTCTTCGGC
GGAGGGACCAGGCTGACCGCCCTA H-Variable (AA):
(SEQ ID NO: 206)
EVQLLESGGGLVQPGGSLRLSCAASGFTFSRYVMFWVRQAPGKGLEWVSG
IYPSGGHTRYADSVKGRFTISRDNSKNTLYLQNNSLRAEDTAVYYCARRG
SGGYFDYWGQGTLVTVSS H-Variable (DNA):
(SEQ ID NO: 207)
GAAGTTCAATTCTTAGAGTCTGGTGGCGGTCTTGTTCAGCCTGGTGGTTC
TTTACGTCTTTCTTGCGCTGCTTCCGGATTCACTTTCTCTCGTTACGTTA
TGTTTTGGGTTCGCCAAGCTCCTGGTAAAGGTTTGGAGTGGGTTTCTGGT
ATCTATCCTTCTGGTGGCCATACTCGTTATGCTGACTCCGTTAAAGGTCG
CTTCACTATCTCTAGAGACAACTCTAACAATACTCTCTACTTGCAGATGA
ACAGCTTAAGGCCTGAGGACACGGCCGTGTATTACTGTGCGAGACGAGGC
TCGGGGGGCTACTTTGACTACTGGGGCCAGCGCACCCTGGTCACCGTCTC
AAGC 12. 806C-M0044-F03
L-Variable (AA):
(SEQ ID NO: 208)
QSALTQDPAVSVALGQTVRITCRGDRLRSYYSSWYQQKPRQAPVLVMFGR
NNRPSGIPDRFSGSTSGSTASLTITATQADDEADYFCSSRDGSGNFLFGG
GTKLTVL L-Variable (DNA):
(SEQ ID NO: 209)
CAGAGCGCTTTGACTCAGGACCCTGCTGTGTCTGTGGCCTTGGGCAGAC
AGTCAGGATCACATGCCGAGGAGACAGACTCAGAAGTTATTATTCAAGTT
GGTACCAGCAGAAGCCACGACAGGCCCCTGTTCTTGTCATGTTTGGTAGA -continued AACAACCGGCCCTCAGGGATCCCAGACCGATTCTCTGGCTCCACCTCAGG
AAGCACAGCTTCCTTGACCATCACTGCGACTCAGGCGGACGATGAGGCTG
ACTATTTCTGTAGTTCCCGGGACGGCAGTGGTAATTTCCTCTTCGGCGGA
GGGACCAAACTGACCGTCCTT H-Variable (AA):
(SEQ ID NO: 210)
EVQLLESGGGLVQPGGSLRLSCAASCFTFSRYKMIWVRQAPGKGLEWVSS
IYPSGGTTSYADSVKGRFTISRDNSKNTLYLQMNSLRAEDTAWYCARSDL
GSGWYSAEYFQHWGQGTLXPTVSS H-Variable (DNA):
(SEQ ID NO: 211)
GAAGTTCAATTGTTAGACTCTGGTGGCGGTCTTGTTCAGCCTGGTGGTTC
TTTACGTCTTTCTTGCGCTGCTTCCGGATTCACTTTCTCTCGTTACAAGA
TGATTTGGGTTCGCCAAGCTCCTGGTAAAGGTTTGGAGTGGGTTTCTTCT
ATCTATCCTTCTGGTGGCACTACTTCTTATGCTGACTCCGTTAAAGGTCG
CTTCACTATCTCTAGAGACAACTCTAAGAATACTCTACTTTGCAGATGA
ACAGCTTAAGGGCTGAGGCACGGCTGTGTATTACTGTGCGAGAAGCGAC
CTAGGCAGTGGCTGGTATAGCGCTGAATACTTCCAGCACTGGGGCCAGGG
CACCCTGGTCACCGTCTCAAGC 13. 806C-M0044-F06
L-Variable (AA):
(SEQ ID NO: 212)
QDIQMTQSPGTLSLSPGERATLSCPASQSVSGNLLAWYQQKPGQAPRLLI
YGASSRATGIPDRFSGSGSGTDFTLTITRLEPEDFAVYFCQQYGGSPPVT
FGGGTKVEIK L-Variable (DNA):
(SEQ ID NO: 213)
CAAGACATCCAGATGACCCAGTCTCCAGGCACCCTGTCTTTGTCTCCAGG
GGAAACAGCCACCCTCTCCTGCAGGGCCAGTCAGAGTGTTAGCGGCAACC
TCTTAGCCTGGTATCAGCAGAAACCTGGCCAGGCTCCCAGACTCCTCATC
TATGGTGCATCCAGCAGGGCCACTGGCATCCCAGACAGGTTCAGTGGCAG
TGGGTCTGGGACAGACTTCACTCTCACCATCACCAGACTGGACCCTGAAG
ATTTTGCAGTGTATTTCTGTCAGCACTATGGTGGCTCACCTCCGGTCACT
TTCGGCGCAGGGACCAAGGTGGAGATCAAA H-Variable (AA):
(SEQ ID NO: 214)
EVQLLESGGGLVQPGGSLRLSCAASCFTFSSYLMIWVRQAPGKGLEWVSR
IYPSGGGTEYADSVKGRFTISRDNSKNTLYLQNNSLRAEDTAVYYCARVT
YYYDSSCYQPAFDIWGQGTMVTVSS H-Variable (DNA):
(SEQ ID NO: 215)
GAAGTTCAATTCTTAGAGTCTGGTGGCGGTCTTGTTCAGCCTGGTGGTTC
TTTACGTCTTTCTTGCGCTGCTTCCGGATTCACTTTCTCTTCTTACCTTA
TGATTTGGGTTCGCCAAGCTCCTGGTAAAGGTTTGGAGTGGGTTTCTCGT
ATCTATCCTTCTGGTGGCGGTACTGAGTATGCTGACTCCGTTAAAGGTCG
CTTCACTATCTCTAGAGACAACTCTAAGAATACTCTACTTTGCAGATGA
ACAGCTTAAGGCCTGAGGACACGCCGTGTATTACTGTGCGAGAGTCACG
TATTACTATGATAGTAGTGGTTATCAACCCGCTTTTGATATCTGGGCCCA
AGGGACAATGGTCACCCTCTCAAGC 14. 806C-M0044-F09
L-Variable (AA):
(SEQ ID NO: 216)
QDIQMTQSPATLSLSPGERATLSCRASQSVSSYLAWYQQKPGQAPRLLIY
DASNRATGIPARFSGSGSGTDFTLIISSLEPEDFAVYYCQQRSNWPRTFG
QGTKVEIK L-Variable (DNA):
(SEQ ID NO: 217)
CAAGACATCCAGATGACCCAGTCTCCAGCCACCCTGTCTTTGTCTCCAGG
GGAAAGAGCCACCCTCTCCTGCAGGGCCAGTCAGAGTGTTAGCAGCTACT
TAGCCTGGTACCAACAGAAACCTGGCCAGGCTCCCAGGCTCCTCATCTAT
GATGCATCCAACAGGGCCACTGGCATCCCAGCCAGGTTCAGTGGCAGTGG
GTCTGGGACAGACTTCACTCTCATCATCAGCAGCCTAGAGCCTGAAGATT
TTGCAGTTTATTATTGTCAGCAGCGTAGCAACTGGCCTCGAACGTTCGGC
CAAGGGACCAAGGTGCAAATCAAA H-Variable (AA):
(SEQ ID NO: 218)
EVQLLESGGGLVQPGGSLRLSCAASGFTFSHYGMTWVRQAPGKGLEWVSV
IGPSGGNTMYADSVKGRFTISRDNSKNTLYLQMNSLRAEDTAVYYCARVW
GAFDIWGQGTMVTVSS H-Variable (DNA):
(SEQ ID NO: 219)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCATTACGGTA
TGACTTGGGTTCGCCAAGCTCCTGGTAAAGGTTTGGAGTGGGTTTCTGTT
ATCGGTCCTTCTGGTGGCAATACTATGTATGCTGACTCCGTTAAAGGTCG
CTTCACTATCTCTACAGACAACTCTAAGAATACTCTACTTTGCAGATGA
ACAGCTTAAGGGCTGAGGACACGCCGTGTATTACTGTCCGAGAGTATGG
GGTGCTTTTGATATCTGGGGCCAAGGGACAATGGTCACCGTCTCAAGC 15. 806C-M0044-G06
L-Variable (AA):
(SEQ ID NO: 220)
QDIQMTQSPATLSVSPGERATLSCRASQSVYNNLAWYQQKPGQAPRLLIY
DASTTATGIPARFSGSGSGTDFTLTITSLEPEDFAVYYCQQRSNWPSLTF
GGGTKXTEIK L-Variable (DNA):
(SEQ ID NO: 221)
CAAGACATCCAGATGACCCAGTCTCCAGCCACCCTGTCTGTGTCTCCAGG
GGAACGAGCCACCCTCTCCTGCAGGGCCAGTCAGAGTGTTTACAACAACT
TAGCCTGGTACCAACAGAAACCTGGCCAGGCTCCCAGGCTCCTCATCTAT
GATGCATCCACCACGGCCACTGGCATCCCAGCCAGGTTCAGTGGCAGTGG
GTCTGGGACAGACTTCACTCTCACCATCACCAGCCTAGAGCCTGAAGATT
TTGCAGTTTATTACTGTCAGCAGCGTAGCAACTGGCCCTCGCTCACTTTC
GGCGGAGGGACCAAGGTGGAGATCAAA H-Variable (AA):
(SEQ ID NO: 222)
EVQLLESGGGLVQPGGSLRLSCAASGFTFSSYKMGWVRQAPGKGLEWVSS
IYPSGGWTHYADSVKGRFTISRDNSKNTLYLQMNSLRAEDTAVYYCARVL
LHYFDYWGQGTLVTVSS H-Variable (DNA):
(SEQ ID NO: 223)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACAAGA
TGGGTTGGGTTCGCCAAGCTCCTGGTAAAGGTTTGGAGTGGGTTTCTTCT
ATCTATCCTTCTGGTGGCTGGACTCATTATGCTGACTCCCTTAAAGGTCG
CTTCACTATCTCTAGAGACAACTCTAAGAATACTCTACTTTGCAGATGA
ACAGCTTAAGGGCTGAGGACACTGCAGTCTACTATTGTGCAAGAGTACTA
CTACACTACTTTGACTACTGGGGCCAGGGAACCCTGGTCACCGTCTCAAG
C 16. 806C-M0044-G07
L-Variable (AA):
(SEQ ID NO: 224)
QDIQMTQSPSFLSASLGDRVTITCRATQGIGTFLAWYQQKAGRAPKLLIY
GASTLQSGVPSRFSGSGSGTEFTLTISSLQPEDFATYYCQQPNSFFGQGT
KLEIK L-Variable (DNA):
(SEQ ID NO: 225)
CAAGACATCCAGATGACCCAGTCTCCATCCTTCCTGTCTGCATCTTTAGG
AGACAGAGTCACCATCACTTGTCGGGCCACTCAGGGCATCGGCACTTTTT
TAGCCTGGTATCAGCAAAAAGCAGGGAGGGCCCCTAAACTCCTGATCTAT
GGTGCTTCCACTTTGCAGAGTGGGGTCCCATCAAGGTTCAGCGGCAGTGG
ATCTGGGACAGAATTCACTCTCACAATAGCAGCCTGCAGCCTGAAGATTT
TGCAACTTATTACTGTCAACAGCCTAATAGTTTTTTTGGGCAGGGGACCA
AGCTGGACATCAAA H-Variable (AA):
(SEQ ID NO: 226)
EVQLLESGGGLVQPGGSLRLSCAASGFTFSSYKNGWVRQAPGKGLEWVSS
IYPSGGWTHYADSVKCRFTISRDNSKNTLYLQMNSLRAEDTAVYYCARVL
LHYFDYWGQGTLVTVSS H-Variable (DNA):
(SEQ ID NO: 227)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACAAGA
TGGGTTGGGTTCGCCAAGCTCCTGGTAAAGGTTTGGAGTGGGTTTCTTCT
ATCTATCCTTCTGGTGGCTGGACTCATTATGCTCACTCCGTTAAAGGTCG
CTTCACTATCTCTAGAGACAACTCTAAGAATACTCTACTTTGCACATGA
ACAGCTTAAGGGCTGAGGACACTGCAGTCTACTATTGTGCAAGAGTACTA
CTACACTACTTTGACTACTGGGGCCAGGGAACCCTGGTCACCGTCTCAAG
C 17. 806C-M0044-G11
L-Variable (AA):

(SEQ ID NO: 228)
QDIQMTQSPSSVSASVGDRVTITCRASQDISSWLVWYQQKPGKAPKLLIH
DASNLQSGVPSRFSGSGSGTDFTLTINSLQPEDFATYYCQQANSFPVTFG
GGTKVEIK

L-Variable (DNA):

(SEQ ID NO: 229)
CAAGACATCCAGATGACCCACTCTCCATCTTCCGTGTCTGCATCTGTAGG
AGACAGAGTCACCATTACTTGTCGGGCGAGTCACCATATTAGCAGTTGGT
TAGTCTGGTATCAGCAGAAACCAGGGAAAGCCCCTAAGCTCCTGATCCAT
GATGCATCCAATTTGCAAAGTGGGGTCCCATCAAGGTTCAGCGGCAGTGG
GTCTGGGACAGATTTTACTCTCACCATCAACAGCCTGCAGCCTGAAGATT
TTGCAACTTACTATTGTCAACAGGCTAACAGTTTCCCGGTCACTTTCGGC
GGAGGGACCAAGGTGGAGATCAAA

H-Variable (AA):

(SEQ ID NO: 230)
EVQLLESGGGLVQPGGSLRLSCAASGFTFSAYPMLWVRQAPGKGLEWVSS
ISPSGGATAYADSVKGRFTISRDNSKNTLYLQNNSLRAEDTAVYYCAKGS
YSDYGVFESWGQGTLVTVSS

H-Variable (DNA):

(SEQ ID NO: 231)
GAAGTTCAATTGTTAGAGTCTGGTGCCGGTCTTGTTCAGCCTGGTGGTTC
TTTACGTCTTTCTTGCGCTGCTTCCGGATTCACTTTCTCTGCTTACCCTA
TGCTTTGGGTTCGCCAAGCTCCTGGTAAAGGTTTGGAGTGGGTTTCTTCT
ATCTCTCCTTCTGGTGGCGCTACTGCTTATGCTGACTCCGTTAAAGGTCC
CTTCACTATCTCTAGAGACAACTCTAAGAATACTCTACTTGCAGATGA
ACAGCTTAAGGGCTGAGGACACGGCCGTGTATTACTGTGCGAAAGGCTCA
TACAGTGATTACGGGGTCTTTGAGTCCTGGGGCCAGGGAACCCTGGTCAC
CGTCTCAAGC 18. 806C-M0044-H03
L-Variable (AA):

(SEQ ID NO: 232)
QRVLTQPPSASGTPGQRVTISCSGSSSNXJGSNNVNWYQQLPGQAPKLLI
DSNNHRPSGVPDRFSGSKSGTSASLALSGLQSEDEADYYCATWDDNLIAP
VFGGGTKLTVL

L-Variable (DNA):

(SEQ ID NO: 233)
CAGAGGGTCTTGACTCACCCACCCTCAGCGTCTGGGACCCCCGGGCAGAG
GGTCACCATCTCCTGTTCTGGAAGCAGCTCCAATGTCGGAAGTAATAATG
TAAACTGGTATCAGCAGCTCCCAGGAACAGGCCCCCAAACTCCTCATCGAT
AGTAATAATCACCGGCCCTCAGGGGTCCCTGACCGATTCTCTGGCTCCAA
GTCTGGCACCTCAGCCTCCCTGGCCCTCAGTGGGCTCCAGTCTGAGGATG
AGGCTGATTATTATTGTGCGACATGGGACGACAACCTGATTGCCCCGGTA
TTCGGCGGAGGGACCAAGCTGACCGTCCTA

H-Variable (AA):

(SEQ ID NO: 234)
EVQLLESGGGLVQPGGSLRLSCAASGFTFSRYRMSWVRQAPGKGLEWVSG
IVPSGGWTTYADSVKGRETISRNSKNTLYLQNNSLRAEDTAVYYCARDNY
YDFWSGYYISRFGMDVWGQGTTVTVSS

H-Variable (DNA):

(SEQ ID NO: 235)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACCGTA
TGTCTTGGGTTCGCCAAGCTCCTGGTAAAGGTTTGGAGTGGGTTTCTGGT
ATCGTTCCTTCTGGTGGCTGGACTACTTATGCTGACTCCGTTAAAGGTCG
CTTCACTATCTCTAGAGACAACTCTAAGAATACTCTACTTGCAGATGA
ACAGCTTAAGGGCTGAGGACACTGCAGTCTACTATTGTGCGAGAGATAAC
TATTACGATTTTTGGAGTGGTTATTATATTTCTCGATTCGGTATGGACGT
CTGGGGCCAAGGGACCACGGTCACCGTCTCAAGC 19. 806C-M0044-H05
L-Variable (AA):

(SEQ ID NO: 236)
QYELTQPASVSGSPGQSITISCTGSSSDVSGYNYVSWYQHHPGKAPKLML
YDVSNRPSGVSNRFSGSKSQNTASLTISGLQAEDEADYYCSSYTSSSTWV
FGGGTKLTVL

L-Variable (DNA):

(SEQ ID NO: 237)
CAGTACGAATTGACTCAGCCTGCCTCCGTGTCTGGGTCTCCTGGACAGTC
GATCACCATCTCCTGCACTGGATCCAGCAGTGACGTTAGTGGTTATAACT
ATGTCTCCTGGTACCAACACCACCCAGGCAAAGCCCCCAAACTCATGCTT
TATGATGTCAGTAATCGGCCCTCAGGGGTTTCTAATCGCTTCTCTGGCTC
CAAGTCTGGCAACACGGCCTCCCTGACCATCTCTGGGCTCCAGGCTGAGG
ACGAGGCTGATTATTACTGCAGCTCATATACAAGCAGCAGCACTTGGGTG
TTCGGCGGAGGGACCAAGCTGACCGTCCTA

H-Variable (AA):

(SEQ ID NO: 238)
EVQLLESGGGLVQPGGSLRLSCAASGFTFSSYMMFWVRQAPGKGLEWVSR
IYPSGGWTYYADSVKGRFTISRDNSKNTLYLQHNSLRAEDTAVYYCARVT
VPLDSGSYYFDYWGQGTLVTVSS

H-Variable (DNA):

(SEQ ID NO: 239)
GAAGTTCAATTGTTAGAGTCTGGTGGCCGTCTTGTTCAGCCTGGTGGTTC
TTTACGTCTTTCTTGCGCTGCTTCCGGATTCACTTTCTCTTCTTACATGA
TGTTTTGGGTTCGCCAAGCTCCTGGTAAAGGTTTGGAGTGGGTTTCTCGT
ATCTATCCTTCTGGTGGCTGGACTTATTATCTGACTCCGTTAAAGGTCG
CTTCACTATCTCTAGAGACAACTCTAAGAATACTCTACTTGCAGATGA
ACAGCTTAAGGGCTGAGGACACGGCCGTGTATTACTGTGCGAGAGTTACG
GTACCCCTTGATAGTGGGAGCTACTACTTTGACTACTGGGGCCAGGGAAC
CCTGGTCACCGTCTCAAGC 20. 806C-M0044-H07
L-Variable (AA):

(SEQ ID NO: 240)
QDIQMTQSPSSLSASVGDRVTITCRASQGIRNDLGWYQQKPGKAPKLLIY
AASSLQSGVPSRFSGSGSGTDFTLTISSLQPEDFATYYCLQDYNYPWTFG
QGTNVEIK

L-Variable (DNA):

(SEQ ID NO: 241)
CAAGACATCCAGATGACCCAGTCTCCATCCTCCCTGTCTGCATCTGTAGG
AGACAGAGTCACCATCACTTGCCCGGCAAGTCAGGGCATTAGAAATGATT
TAGGCTGGTATCAGCAGAAACCAGGGAAAGCCCCTAAGCTCCTGATCTAT
GCTGCATCCAGTTTACAAAGTGGGGTCCCATCAAGGTTCAGCGGCAGTGG
ATCTGGGACAGATTTCACTCTCACCATCAGCAGCCTGCAGCCTGAAGATT
TTGCAACTTATTACTGTCTACAAGATTACAATTACCCGTGGACGTTCGGC
CAAGGCACCAATGTGGAAATCAAA

H-Variable (AA):

(SEQ ID NO: 242)
EVQLLESGGGLVQPGGSLRLSCAASGFTFSSYLMTWVRQAPGKGLEWVSS
IYPSGGWTYYADSVKGRETISRDNSKNTLYLQNNSLRAEDTATYYCAREM
YYDFWSGYYRGFDIWGQGTTVTVSS

H-Variable (DNA):

(SEQ ID NO: 243)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACCTTA
TGACTTGGGTTCGCCAAGCTCCTGGTAAAGGTTTGGAGTGGGTTTCTTCT
ATCTATCCTTCTGGTGGCTGGACTTATTATGCTGACTCCGTTAAAGGTCG
CTTCACTATCTCTAGAGACAACTCTAAGAATACTCTACTTGCAGATGA
ACAGCTTAAGGGCTGAGGACACAGCCACATATTACTGTGCGAGAGAGATG
TATTACGATTTTTGGAGTGGTTATTATCGAGGTTTTGATATCTGGGGCCA
AGGGACCACGGTCACCGTCTCAAGC 21. 806C-M0044-H09
L-Variable (AA):

(SEQ ID NO: 244)
QDIQMTQSPSTLSASIGDRVTITCRASQRVSTWVAWYQQKPGRAPKLLIY
MASRLESGVPSRFSGSGSGTEFTLTISSLQPDDFATYWCQQYNFYPRTFG
QGTKVDIK

L-Variable (DNA):

(SEQ ID NO: 245)
CAAGACATCCAGATGACCCAGTCTCCTTCCACCCTGTCTGCATCTATAGG
AGACAGAGTCACCATCACTTGCCGGGCCAGTCAGCGTGTTAGTACTTGGG
TGGCCTGGTATCAGCAGAAACAGGGGAGCCCCAAAACTCTTGATCTAT
ATGGCGTCTAGGTTAGAAAGTGGGGTCCCATCAAGGTTCAGCGGCAGTGG
ATCTGGGACAGAGTTCACTCTCACCATAAGCAGCCTGCAGCCTGATGATT
TTGCTACTTATTGGTGCCAACAATATAATTTTTATCCTCGGACGTTCGGC
CAAGGGACCAAGGTGGACATCAAA

H-Variable (AA):
(SEQ ID NO: 246)
EVQLLESGGGLVQPGGSLRLSCAASGFTFSWYGMNWVRQAPGKGLEWVSS
ISPSGGQTPYADSVKGRFTISRDNSNTLYLQMNSLRAEDTAVYYCARDLG
GAYIPDSWGQGTLVTVSS H-Variable (DNA):
(SEQ ID NO: 247)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTGGTACGGTA
TGAATTGGGTTCGCCAAGCTCCTGGTAAAGGTTTGGACTGGGTTTCTTCT
ATCTCTCCTTCTGGTCGCCAGACTCCTTATGCTGACTCCGTTAAAGGTCG
CTTCACTATCTCTAGAGACAACTCTAAGAATACTCTACTTGCAGATGAA
ACAGCTTAAGGGCTGAGGACACGCCGTGTATTACTGTGCGCGAGATCTC
GGTGGGGCCTACATACCTGACTCCGGGGCAGGGCACCCTGGTCACCGT
CTCAAGC 22. 806C-M0045-A02
L-Variable (AA):
(SEQ ID NO: 248)
QDIQMTQSPSFLSASVGDRVTITCRASQGISNYLAWYQQEPGKAPKLLIY
SASTLQTGVPSRFSGSGSGTEFTLTISSLQPEDFATYYCQQFNSYPRTFG
HGTKVEFK L-Variable (DNA):
(SEQ ID NO: 249)
CAAGACATCCAGATGACCCAGTCTCCTTCCTTCCTGTCTGCATCTGTGGG
AGACAGAGTCACCATCACTTGCCCGGCCAGTCAGGGCATTAGCAATTATT
TAGCCTGGTATCAGCAAGAACCAGGGAAAGCCCCTAAGCTCCTCATCTAT
TCTGCCTCCACTTTGCAAACTGGAGTCCCATCAAGGTTCAGCGGCAGTGG
ATCTGGGACAGAGTTCACTCTCACAATCAGCAGCCTGCAGCCTGAGGATT
TTGCAACTTATTACTGTCAACAGTTTAACAGTTACCCTCGAACGTTCGGC
CACGGGACCAAGGTGGAATTCAAA H-Variable (AA):
(SEQ ID NO: 250)
EVQLLESGGGLVQPGGSLRLSCAASGFTFSTYPNMWVRQAPGKGLEWVSV
ISPSGGQTSYADSVKGRFTISRDNSKNTLYLQMNSLRAEDTAVYYCTRGG
RLNAFDIWGQGTMVTVSS H-Variable (DNA):
(SEQ ID NO: 251)
GAAGTTCAATTGTTAGAGTCTGGTGGCGGTCTTGTTCAGCCTGGTGGTTC
TTTACGTCTTTCTTGCGCTGCTTCCGGATTCACTTTCTCTACTTACCCTA
TGATGTGGGTTCGCCAAGCTCCTGGTAAAGGTTTGGAGTGGGTTTCTGTT
ATCTCTCCTTCTGGTGGCCAGACTTCTTATGCTGACTCCGTTAAAGGTCG
CTTCACTATCTCTAGAGACAACTCTAAGAATACTCTACTTGCAGATGAA
ACAGCTTAAGGGCTGAGGACACAGCCGTGTATTACTGTACGACAGGGGGG
AGGCTGAATGCTTTTGATATCTGGGGCCAAGGGACAATGGTCACCGTCTC
AAGC 23. 806C-M0045-A04
L-Variable (AA):
(SEQ ID NO: 252)
QSALTQDPAVSVALGQTVRFTCQGDSLRNYHPSWYQQKPGQAPVLVIYGK
NNRPSGIPDRFSGSSSGNTASLTITGAQAEDEADYYCNSRDSSGNHVFGT
GTKVTVL L-Variable (DNA):
(SEQ ID NO: 253)
CACAGCGCTTTGACTCAGCACCCTGCTGTGTCTGTGGCCTTGGGACAGAC
AGTCAGGTTCACTTGCCAAGGAGACAGCCTCAGAAATTATCATCCAAGCT
GGTACCAGCAGAAGCCAGGACAGGCCCCTGTACTTGTCATCTATGGTAAA
AACAACCGGCCCTCAGGGATCCCAGACCGATTCTCTGGCTCCAGCTCAGG
AAACACAGCTTCCTTGACCATCACTGGGGCTCAGGCGGAAGATGAGGCTG
ACTATTACTGTAACTCCCGGGACAGCACTGGTAACCATGTCTTCGGAACT
GGGACCAAGGTCACCGTCCTA H-Variable (AA):
(SEQ ID NO: 254)
EVQLLESGGGLVQPGGSLRLSCAASGFTFSIYQMGWVRQAPCKGLEWVSR
IYPSGGVTKYADSVKGRFTISRDNSKNTLYLQMNSLRAEDTAVYYCARDF
GPGDLWSGYYDAFDIWGQGTMVTVSS H-Variable (DNA):
(SEQ ID NO: 255)
GAAGTTCAATTGTTAGAGTCTGGTGGCGGTCTTGTTCAGCCTGGTGGTTC
TTTACGTCTTTCTTGCGCTGCTTCCGGATTCACTTTCTCTATTTACCAGA
TGGGTTGGGTTCGCCAAGCTCCTGGTAAAGGTTTGGAGTGGGTTTCTCGT
ATCTATCCTTCTGCTGGCGTTACTAAGTATGCTGACTCCGTTAAAGGTCG
CTTCACTATCTCTAGAGACAACTCTAAGAATACTCTCTACTTGCAGATGA
ACAGCTTAAGGGCTGAGGACACGGCTGTGTATTACTGTGCCAGAGATTTC
GGTCCGGGCGATTTATGGAGTGGTTATTATGATGCTTTTGATATCTGGGG
CCAAGGGACAATGGTCACCGTCTCAAGC 24. 806C-M0045-B01
L-Variable (AA):
(SEQ ID NO: 256)
QSALTQPASASGSPGQSVTISCTGTSSDVGGYNYVSWYQQHPGKAPKLMI
YEVSKRPSGVPDRFSGSKSATTASLTVSGLQAEDEADYYCSSYAGSNNLI
FGGGTKVTVL L-Variable (DNA):
(SEQ ID NO: 257)
CAGAGCGCTTTGACTCAGCCTGCCTCCGCGTCCGGGTCTCCTGGACAGTC
AGTCACCATCTCCTGCACTGGAACCAGCAGTGACGTTGGTGGTTATAACT
ATCTCTCTGGTACCAACAACACCAGGCAAAGCCCCCAAACTCATGATT
TATGAGGTCAGTAAGCGGCCCTCAGGGGTCCCTGATCGCTTCTCTGGCTC
CAAGTCTGCCACCACGGCCTCCCTCACCGTCTCTGCGCTCCAGGCTGAGG
ATGAGGCTGATTATTACTGCAGCTCATATGCAGGCAGCAACAATTTGATA
TTCGGCGGGGGGACCAAGGTGACCGTCCTA H-Variable (AA):
(SEQ ID NO: 258)
EVQLLESGGGLVQPGGSLRLSCAASGFTFSSYQMQWVRQAPGKGLEWVSV
IYPGGYTYYADSVKGRFTISRDNSKNTLYLQMNSLPAEDTAVYYCARLQF
YGSSAAFDIWGQGTMVTVSS H-Variable (DNA):
(SEQ ID NO: 259)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACCAGA
TGCAGTGGGTTCGCCAAGCTCCTGGTAAAGGTTTGGAGTGGGTTTCTGTT
ATCTATCCTGGTGGCTATACTTATTATGCTGACTCCGTTAAAGGTCGCTT
CACTATCTCTAGAGACAACTCTAAGAATACTCTACTTGCAGATGAACA
GCTTAAGGGCTGAGGACACGGCCGTGTATTACTGTCAAGACTCCAGTTC
TACGGTTCCTCTGCTGCTTTTGACATCTGGGGCCAAGGGACAATGGTCAC
CGTCTCAAGC 25. 806C-M0045-B03
L-Variable (AA):
(SEQ ID NO: 260)
QDIQMTQSPDTLSLSPGERATLSCRASQSISRYLAWYQQRPGQAPSLLIY
DASEPAAGIPARFSGSGSGTDFTLTISSLEPEDFAVYYCQQRGNWPLTFG
GGTKVDIR L-Variable (DNA):
(SEQ ID NO: 261)
CAAGACATCCAGATGACCCAGTCTCCAGACACCCTGTCTTTGTCTCCAGG
GGAAAGAGCCACCCTCTCCTGCAGGGCCAGTCAGAGTATTAGTAGATACT
TAGCCTGGTACCAACAAAGACCTGGCCAGGCTCCCAGCTCCTCATCTAT
GATGCATCCGAAAGGGCCGCTGGCATCCCAGCCAGGTTCAGTGGCAGTGG
GTCTGGGACAGACTTCACTCTCACCATCAGCAGCCTGGAGCCTGAAGATT
TTGCAGTTTATTACTGTCAGCAACGTGGCAACTGGCCGCTCACTTTCGGC
GGAGGGACCAAGGTGGACATCAGA H-Variable (AA):
(SEQ ID NO: 262)
EVQLLESGGGLVQPGGSLRLSCAASGFTFSQYPMIWVRQAPGKGLEWVSV
ISPSGGHTSYADSVKGRFTISRDNSKNTLYLQMNSLRAEDTAVYYCARIQ
YYGGAFDIWGQGKMVTVSS H-Variable (DNA):
(SEQ ID NO: 263)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCAGTACCCTA
TGATTTGGGTTCGCCAAGCTCCTGGTAAAGGTTTGGAGTGGGTTTCTGTT
ATCTCTCCTTCTGGTGGCCATACTTCTTATGCTGACTCCGTTAAAGGTCG
CTTCACTATCTCTAGAGACAACTCTAAGAATACTCTACTTGCAGATGAA
ACAGCTTAAGGGCTGAGGACACGGCCGTGTATTACTGTGCGAGAATCCAG
TACTACCGTGGGGCTTTTGATATCTGGGGCCAAGGGAAAATCGTCACCGT
CTCAAGC 26. 806C-M0045-B11
L-Variable (AA):
(SEQ ID NO: 264)
QDIQMTQSPATLSLSPGERATLSCRASQSVSSYLAWYQQKPGQAPRLLIY
DASNRATGIPARFSGSGSGTDFTLTISSLEPEDFAVYYCQQRSNWPHTFG
GGTKVEIK L-Variable (DNA):
(SEQ ID NO: 265)
CAAGACATCCAGATGACCCAGTCTCCAGCCACCCTGTCTTTGTCTCCAGG
GGAAAGAGCCACCCTCTCCTGCAGGGCCAGTCAGAGTGTTAGCAGCACTT
AGCCTGGTACCAACAGAAACCTGGCCAGGCTCCCAGGCTCCTCATCTAT
GATGCATCCAACAGGGCCACTGGCATCCCAGCCAGGTTCAGTGGCAGTGG
GTCTGGGACAGACTTCACTCTCACCATCAGCAGCCTAGAGCCTGAAGATT
TTGCAGTTTATTACTGTCAGCAGCGTAGCAACTGGCCTCACACTTTCGGC
GGAGGGACCAAGGTGGAGATCAAA H-Variable (AA):
(SEQ ID NO: 266)
EVQLLESGCGLVQPGGSLRLSCAASCFTFSPYGMLWVRQAPGKGLEWVSV
ISPSGGQTFYADSVKGRFTISRDNSKNTLYLQMNSLRAEDTAVYYCARLG
AEKGMDVWGQGTTVTVSS H-Variable (DNA):
(SEQ ID NO: 267)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCCTTACGGTA
TGCTTTGGGTTCGCCAAGCTCCTGGTAAAGGTTTGGAGTGGCTTTCTGTT
ATCTCTCCTTCTGGTGGCCAGACTTTTTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGGCTAGGT
GCGGAAAAAGGTATGGACGTCTGGGGCCAAGGGACCACGGTCACCGTCTC
AAGC 27. 806C-M0045-C02
L-Variable (AA):
(SEQ ID NO: 268)
QDIQMTQSPATLSVSPGERATLSCRASQSVSSNLAWYQQRPGQAPRLLIR
YGASSRATGIPDRFSGSGSGTDFTLTISRLEPEDFAVYYCQQYGSSPRTF
GQGTKVEIK L-Variable (DNA):
(SEQ ID NO: 269)
CAAGACATCCAGATCACCCAGTCTCCAGCCACCCTGTCTGTGTCTCCAGG
GGAAAGAGCCACCCTCTCCTGCAGGGCCAGTCAGAGTGTTAGCAGCAACT
TAGCCTGGTACCAGCAGAGACCTGGCCAGGCTCCCAGGCTCCTCATCTAT
GGTGCATCCAGCAGGGCCACTGGCATCCCAGACAGGTTCAGTGGCAGTGG
GTCTGGGACAGACTTCACTCTCACCATCAGCAGACTGGAGCCTGAAGATT
TTGCAGTGTATTACTGTCAGCAGTATGGTAGCTCACCTCGGACGTTCGGC
CAAGGGACCAAGGTGGAAATCAAA H-Variable (AA):
(SEQ ID NO: 270)
EVQLLESGGGLVQPGGSLRLSCAASGFTFSRYVMGWVRQAPGKGLEWVSS
IYPSGGYTYYADSVKGRFTISRDNSKNTLYLQNNSLRAEDTAVYYCAKDS
PHCSGGSCYGGYYYGMDVWGQGTTVTVSS H-Variable (DNA):
(SEQ ID NO: 271)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACGTTA
TGGGTTGGGTTCGCCAAGCTCCTGGTAAACGTTTGGAGTGGGTTTCTTCT
ATCTATCCTTCTGGTGGCTATACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAAAGATTCC
CCGCATTGTAGTGGTGGTAGCTGCTACGGGGGCTACTACTACTACGGTAT
GGACGTCTGGGGCCAAGGCACCACGGTCACCGTCTCAAGC 28. 806C-M0045-C11
L-Variable (AA):
(SEQ ID NO: 272)
QSELTQPASVSGSPGQSITISCTGTNRDVGGYNYVSWYQQHPGKAPKLMI
YDVSNRPSGVSNRFSGSKSGNTASLTISGLQADDEAEYYCSSYTSSGTRV
FGTGTKVTVL L-Variable (DNA):
(SEQ ID NO: 273)
CAGAGCGAATTGACTCAGCCTGCCTCCGTCTCTGGGTCTCCTGGACAGTC
GATCACCATCTCCTGCACTGGAACCAACAGAGACGTTGGTGGTTATAACT
ATGTCTCCTGGTACCAACAACACCCAGGCAAAGCCCCCAAACTCATGATT
TATGATGTCAGTAATCGGCCCTCAGGGGTTTCTAATCGCTTCTCTGGCTC
CAAGTCTGGCAACACGGCCTCCCTGACCATCTCTGGGCTCCAGGCTGACG
ACGAGGCTGAGTATTACTGCAGCTCATATACAAGCAGCGGCACTCGAGTC
TTCGGAACTGGGACCAAGGTCACCGTCCTA H-Variable (AA):
(SEQ ID NO: 274)
EVQLLESGGGLVQPGGSLRLSCAASGFTFSHYIMVWVRQAPGKGLEWVSS
IYPSGGVTYYADSVKGRFTISRDNSKNTLYLQMNSLRAEDTAVYYCARDV
AGALDYWGQGTLVTVSS H-Variable (DNA):
(SEQ ID NO: 275)
GAAGTTCAATTGTTAGAGTCTGGTGGCCGTCTTGTTCAGCCTGGTGGTTC
TTTACGTCTTTCTTGCCCTGCTTCCGGATTCACTTTCTCTCATTACATTA
TGGTTTGGGTTCGCCAAGCTCCTGGTAAAGGTTTGGAGTGGGTTTCTTCT
ATCTATCCTTCTGGTGGCGTTACTTATTATGCTGACTCCCTTAAAGGTCG
CTTCACTATCTCTAGAGACAACTCTAAGAATACTCTCTACTTGCAGATGA
ACAGCTTAAGGGCTGAGGACACGCCGTGTATTACTGTGCGAGAGATGTT
GCCGGAGCTCTTGACTACTGGGGCCAGGGAACCCTGGTCACCGTCTCAAG
C 29. 806C-M0045-C12
L-Variable (AA):
(SEQ ID NO: 276)
QYELTQPASVSGSPGQSITISCTGTSTDVGGYNYVSWYQKHPGKAPKLMI
YDVSNRPSGVSNRFSGSKSGNTASLTISGLQAEDEADYYCSSYTNTITVV
FGGGTKLTVL L-Variable (DNA):
(SEQ ID NO: 277)
CAGTACGAATTGACTCAGCCTGCCTCCCTGTCTGGCTCTCCTGGACAGTC
GATCACCATCTCCTGCACTGGAACCAGCACTGACGTTGGTGGTTATAACT
ATGTCTCCTGGTACCAAAAACACCCAGGCAAAGCCCCCAAACTCATGATT
TATGATGTCAGTAACCGGCCCTCTGGGGTTTCTAATCGCTTCTCTGGCTC
CAAGTCTGGCAACACGGCCTCCCTGACCATCTCTGGGCTCCAGCTGAGG
ACGAGGCTGACTATTACTGCAGCTCATATACAAACACCATCACCGTGGTG
TTCGGCGGAGGGACCAAGCTGACCGTCCTA H-Variable (AA):
(SEQ ID NO: 278)
EVQLLESGGGLVQPGGSLRLSCAASGFTFSKYWIMHWVRQAPGKGLEWVS
SIYSSGGRTHYADSVKGRFTISRDNSKNTLYLQNNSLRAEDTMTYYCAHT
DSSTWYRWYFDLWGRGTLVTVSS H-Variable (DNA):
(SEQ ID NO: 279)
GAACTTCAATTGTTAGAGTCTGGTGGCGGTCTTGTTCAGCCTGGTGGTTC
TTTACGTCTTTCTTGCGCTGCTTCCGGATTCACTTTCTCTAAGTACTGGA
TGCATTGGGTTCGCCAAGCTCCTGGTAAAGGTTTGGAGTGGGTTTCTTCT
ATCTATTCCTTCTGGTGGCCGTACTCATTATGCTGACTCCGTTAAAGGTCG
CTTCACTATCTCTAGAGACAACTCTAACAATACTCTCTACTTGCAGATGA
ACAGCCTAAGGGCTGAGGACACCGCCATCTATTACTGTGCACACACTGAT
AGCAGCACCTGGTACCGGTGGTACTTCGATCTCTGGGGCCGTGGCACCCT
GGTCACCGTCTCAAGC 30. 806C-M0045-D01
L-Variable (AA):
(SEQ ID NO: 280)
QDIQMTQSPSTLSSSVGDRVTITCRASQSVSNWLAWYQQKPGKAPKVLIY
KASTLESGVPSRFSGSGSGTEFTLTISSLQPDDFATYYCQHYHRYSRTFG
QGTKVEIK L-Variable (DNA):
(SEQ ID NO: 281)
CAAGACATCCAGATGACCCAGTCTCCTTCCACCCTGTCTTCATCTGTAGG
AGACAGAGTCACCATCACTTGCCGGCCCACTCAGAGTGTTAGTAACTCGT
TGGCCTGGTATCAGCAGAAACCAGGGAAAGCCCCTAAGGTCCTAATCTAT
AAGGCGTCTACTTTAGAAAGTGGGGTCCCGTCAAGGTTCAGCGGCAGTGG
ATCTGGGACAGAATTCACTCTCACCATCAGCAGCCTGCAGCCTGATGATT
TTGCAACTTATTACTGCCAACATTATCATCGTTATTCTCGAACGTTCGGC
CAAGGGACCAAGGTGGAAATCAAA H-Variable (AA):
(SEQ ID NO: 282)
EVQLLESGGGLVQPGGSLRLSCAASGFTFSAYKMTWVRQAPGKGLEWVSS
IYPSGGWTWYADSVKGRFTISRDNSKNTLYLQMNSLRAEDTAVYYCARDN
WQGGAFDIWGQGTMVTVSS H-Variable (DNA):
(SEQ ID NO: 283)
GAAGTTCAATTGTTAGAGTCTGGTGCCGGTCTTGTTCAGCCTGGTGGTTC
TTTACGTCTTTCTTGCGCTGCTTCCGGATTCACTTTCTCTGCTTACAAGA
TGACTTGGGTTCGCCAAGCTCCTGGTAAAGGTTTGGAGTGGGTTTCTTCT
ATCTATCCTTCTGGTGGCTGGACTTGGTATGCTGACTCCGTTAAAGGTCG -continued
CTTCACTATCTCTAGAGACAACTCTAAGAATACTCTCTACTTGCAGATGA
ACAGCTTAAGGGCTGAGGACACGGCCGTGTATTACTGTCCGAGAGATAAC
TGGCAGGGCGGTGCTTTTCACATCTGCGGCCATGGGACAATGGTCACCCT
CTCAAGC 31. 806C-M0045-D07
L-Variable (AA):
(SEQ ID NO: 284)
QDIQMTQSPGTLSLSPGERATLSCRASQSVNSNQLAWYQQKPGQAPRLLI
YGASNRATGIPARFSGSGSGTDFTLTISSLEPEDFAVYYCQQRSNFWTFG
QGTKVEIK L-Variable (DNA):
(SEQ ID NO: 285)
CAAGACATCCAGATGACCCAGTCTCCAGGCACCCTGTCTTTGTCTCCAGG
GGAAAGAGCCACCCTCTCCTGCAGGGCCACTCAGAGTGTTAACAGCAACC
AGTTAGCCTGGTACCAGCAGAAACCTGGCCAGGCTCCCAGGCTCCTCATC
TATGGTGCATCCAACAGGGCCACTGGCATCCCACCCAGGTTCAGTCGCAG
TGGGTCTGGGACAGACTTCACTCTCACCATCAGCAGCCTAGAGCCTGAAG
ATTTTGCCAGTCTATTACTGTCAGCAGCGTAGCAACTTTTGGACGTTCGGC
CAAGGGACCAAGGTGGAAATCAAA H-Variable (AA):
(SEQ ID NO: 286)
EVQLLESGGGLVQPGGSLRLSCAASGFTFSRYLMMWVRQAPGKGLEWVSS
IYPSGGWTYYADSVKGRFTISRDNSKNTLYLQNNSLRAEDTAITYYCARV
APYDSSGSVNYAFDPWGQGTLVTVSS H-Variable (DNA):
(SEQ ID NO: 287)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACCTTA
TGATGTGGGTTCGCCAAGCTCCTGGTAAAGGTTTGGAGTGGGTTTCTTCT
ATCTATCCTTCTGGTGGCTGGACTTATTATGCTGACTCCGTTAAAGGTCG
CTTCACTATCTCTAGAGACAACTCTAAGAATACTCTCTACTTGCAGATGA
ACAGCTTAAGGGCTGAGGACACCGCCATGTATTACTGTGCCAGAGTCCCC
CCCTATGATAGTAGTGGTTCGGTAAATTACGCGTTCGACCCCTGGGGCCA
GGGCACCCTGGTCACCGTCTCAACC 32. 806C-M0045-G01
L-Variable (AA):
(SEQ ID NO: 288)
QDIQMTQSPSSLSASVGDRVTITCRASQNINIYLNWYQQKPGRAPSLLIY
TQSNLRSGVPSRFSGSGYCTDFTLTISGLQPEDFATYYCQQSHSAPRTFG
QGTRVEIK L-Variable (DNA):
(SEQ ID NO: 289)
CAAGACATCCAGATGACCCAGTCTCCATCCTCCCTGTCTGCATCTGTAGG
AGACAGAGTCACCATCACTTGCCGGGCAAGTCAGAACATTAACATCTATT
TGAATTGGTATCAGCAAGAAGCCAGGGAGAGCCCCTAGCCTCCTGATTTAT
ACTCAATCCAATTTGCGAAGTGGGGTCCCATCAAGGTTCAGTGGCAGTGG
ATATGGCACAGATTTCACTCTCACCATCAGCGGTCTGCAACCTGAAGATT
TTGCAACTTACTACTGTCAACAGAGTCACACTGCCCCCCGGACGTTCGGC
CAGGGGACCAGGGTGGAAATCAAA H-Variable (AA):
(SEQ ID NO: 290)
EVQLLESGGGLVQPGGSLRLSCAASGFTFSHYKMVWVRQAPCKGLEWVSV
IYPSGGWTRYADSVKGRFTISRDNSKNTLYLQMNSLRAEDTAVYYCAREM
IDTISPGWHFDLWGRGTLVTVSS H-Variable (DNA):
(SEQ ID NO: 291)
GAAGTTCAATTGTTAGAGTCTGGTGGCGGTCTTGTTCAGCCTGGTGGTTC
TTTACCTCTTTCTTGCGCTGCTTCCGGATTCACTTTCTCTCATTACAAGA
TGGTTTGGGTTCGCCAAGCTCCTGGTAAAGGTTTGGAGTGGGTTTCTGTT
ATCTATCCTTCTGGTGGCTGGACTCGTTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCAAGAGAAATG
ATTGACACTATTTCGCCCGGCTGGCACTTCGATCTCTGGGGCCGTGGCAC
CCTGGTCACCGTCTCAAGC 33. 806C-M0045-G10
L-Variable (AA):
(SEQ ID NO: 292)
QSELTQDPAVSVALGQTVRITCQGDSLRSYYASWYQQKPGQAPVLVMYGK
NNRPSGIPDRFSGSSSCNTASLTITGAQAEDEADYYCQSRGSSSGNHYVF
GTGTKVTVL -continued
L-Variable (DNA):
(SEQ ID NO: 293)
CAGAGCGAATTGACTCAGGACCCTGCTGTGTCTGTGGCCTTGGGACAGAC
AGTCAGGATCACATGCCAAGGAGACAGCCTCAGAAGCTATTATGCAAGCT
GGTACCAGCAGAAGCCAGGACAGGCCCCTGTACTTGTCATGTATGGTAAA
AACAACCGGCCCTCAGGGATCCCAGACCGATTCTCTGGCTCCAGTTCAGC
AAACACAGCTTCCTTGACCATCACTGGGGCTCAGGCGGAAGATGAGGCTG
ACTATTACTGTCAGTCCCGGGGCAGCAGCAGTGGTAACCATTATCTCTTC
GGAACTGGGACCAAGGTCACCGTCCTA H-Variable (AA):
(SEQ ID NO: 294)
EVQLLESGGGLVQPGGSLRLSCAASGFTFSRYQMMWVRQAPGKGLEWVSS
IYPSGGFTRYADSVKGRETISRDNSKNILYLQMNSLRAEDTAVYYCAKSY
YYGSGTYHYSYYGMDVWGQGTTVTVSS H-Variable (DNA):
(SEQ ID NO: 295)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACCAGA
TGATGTGGGTTCGCCAAGCTCCTGGTAAAGGTTTGGAGTGGGTTTCTTCT
ATCTATCCTTCTGGTGGCTTTACTCGTTATGCTGACTCCGTTAAAGGTCG
CTTCACTATCTCTAGAGACAACTCTAAGAATATTCTCTACTTGCAGATGA
ACAGCTTAAGGGCTGAGGACACGGCCGTATATTACTGTGCGAAATCATAT
TACTATGGGTCGGGGACCTATCATTACTCTTACTACGGTATGGACGTCTG
GGGCCAAGGGACCACGGTCACCGTCTCAAGC 34. 806C-M0046-A11
L-Variable (AA):
(SEQ ID NO: 296)
QDIQMTQSPGTLSLSPGERATLSCRASQSVSSTYLAWYQQKPGQAPRLLI
YGASSRATGIPDRFTGSGSGTDFTLTISRLEPEDFAVYYCQHYGSSPLTF
GGGTKVEIK L-Variable (DNA):
(SEQ ID NO: 297)
CAAGACATCCAGATGACCCAGTCTCCAGGCACCTTGTCTTTGTCTCCAGG
GGAAAGAGCCACCCTCTCCTGCAGGGCCAGTCAGAGTGTTAGTAGCACCT
ACTTAGCCTGGTACCAGCAGAAACCTGGCCAGGCTCCCAGGCTCCTCATC
TATGGTGCATCCAGCAGGGCCACTGGCATCCCAGACAGGTTCACTGGCAG
TGGGTCTGGGACAGACTTCACTCTCACCATCAGCAGACTGGAGCCTGAAG
ATTTTGCAGTGTATTACTGTCAGCACTATGGTAGCTCACCGCTCACTTTC
GGCGGAGGGACCAAGGTGGAGATCAAA H-Variable (AA):
(SEQ ID NO: 298)
EVQLLESGGGLVQPGGSLRLSCAASGFTFSRYRMDWVRQAPGKGLEWVSG
IYPSGGHTYYADSVKGRFTISRDNSKNTLYLQMNSLRAEDTATYYCARLY
LWGSYPTQVAFDTWGQGTMVTVSS H-Variable (DNA):
(SEQ ID NO: 299)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACCCTA
TGGATTGGGTTCGCCAAGCTCCTGGTAAAGGTTTGGAGTGGGTTTCTGGT
ATCTATCCTTCTGGTGGCCATACTTATTATGCTGACTCCGTTAAAGGTCG
CTTCACTATCTCTAGAGACAACTCTAAGAATACTCTCTACTTGCAGATGA
ACAGCTTAAGGGCTGAGGACACAGCCACGTATTACTGTGCGAGACTTTAC
CTTTGGGGAGTTATCCCACCCAGGTTGCTTTTGATATCTGGGGCCAAGG
GACAATGGTCACCGTCTCAAGC 35. 806C-M0046-B06
L-Variable (AA):
(SEQ ID NO: 300)
QDIQMTQSPATLSVSPGERATLSCRASQSVSSNLAWYQQKPGQAPRLLIY
GASTRATGIPARFSGSGSGTDFTLTISSLEPEDFAVYYCQQRSNWPLTFG
GGTKVEIK L-Variable (DNA):
(SEQ ID NO: 301)
CAAGACATCCAGATGACCCAGTCTCCACCCACCCTGTCTGTGTCTCCAGG
GGAAAGAGCCACCCTCTCCTGCAGGGCCAGTCAGAGTGTTAGCAGCAACT
TAGCCTCGTACCAGCAGAAACCTGGCCAGGCTCCCAGGCTCCTCATCTAT
GGTGCATCCACCAGGGCCACTGGTATCCCAGCCAGGTTCAGTGGCAGTGG
GTCTGGGACAGACTTCACTCTCACCATCAGCAGCCTAGAGCCTGAACATT
TTGCAGTTTATTACTGTCAGCAGCCTAGCAACTGGCCGCTCACTTTCGGC
CGAGGGACCAAGGTGGAGATCAAA -continued H-Variable (AA):
(SEQ ID NO: 302)
EVQLLESGGGLVQPGGSLRLSCAASCFTFSMYPMLWVRQAPGKGLEWVSS
IYPSGGMTYYADSVKGRFTISRDNSKNTLYLQMNSLRAEDTAVYYCARQG
YYDSSGWTFDYWGQGTLVTVSS H-Variable (DNA):
(SEQ ID NO: 303)
GAAGTTCAATTGTTAGAGTCTGGTGGCGGTCTTGTTCAGCCTGGTGGTTC
TTTACGTCTTTCTTGCGCTGCTTCCGGATTCACTTTCTCTATGTACCCTA
TGCTTTGGGTTCGCCAAGCTCCTGGTAAAGGTTTGGAGTGGGTTCTTCT
ATCTATCCTTCTGGTGGCATGACTTATTATGCTGACTCCGTTAAAGGTCG
CTTCACTATCTCTACAGACAACTCTAAGAATACTCTCTACTTGCAGATGA
ACAGCTTAAGGGCTGAGGACACGCCGTGTATTACTGTGCGAGACAAGCT
TACTATGATAGTAGTGGGTGGACCTTTGACTACTGGGGCCAGGGAACCCT
GGTCACCGTCTCAAGC 36. 806C-M0046-B10
L-Variable (AA):
(SEQ ID NO: 304)
QDIQMTQSPATLSLSPGERATLSCRASQSVSSYLAWYQQKPGQAPRLLIY
DASNRATGIPARESQSGSGTDFTLTISSLEPEDFAVYYCQQRSNWPLTFG
GGTKVEIK L-Variable (DNA):
(SEQ ID NO: 305)
CAAGACATCCAGATGACCCAGTCTCCAGCCACCCTGTCTTTGTCTCCAGG
GGAAAGAGCCACCCTCTCCTGCAGGGCCAGTCAGAGTGTTAGCACCTACT
TAGCCTGGTACCAACAGAAACCTGGCCAGGCTCCCAGGCTCCTCATCTAT
GATGCTCCAACAGGGCCACTGGCATCCCAGCCAGGTTCAGTCGCAGTGG
GTCTGGGACAGACTTCACTCTCACCATCAGCAGCCTAGAGCCTGAAGATT
TTGCAGTTTATTACTGTCAGCAGCGTAGCAACTGGCCGCTCACTTTCGGC
GGAGGGACCAAGGTGGAGATCAAA H-Variable (AA):
(SEQ ID NO: 306)
EVQLLESGGGLVQPGGSLRLSCAASGFTFSAYVMNWVRQAPGKGLEWVSG
IYSSGGYIYYADSVKGRFTISRDNSKNTLYLQMNSLPAEDTATYYCARRH
FNGVGFDLWGQGTMVTVSS H-Variable (DNA):
(SEQ ID NO: 307)
GAAGTTCAATTGTTAGAGTCTGGTGGCGGTCTTGTTCAGCCTGGTGGTTC
TTTACGTCTTTCTTGCGCTGCTTCCGGATTCACTTTCTCTGCTTACGTTA
TGAATTGGGTTCGCCAAGCTCCTGGTAAAGGTTTGGAGTGGGTTTCTGGT
ATCTATTCTTCTGGTGGCTATATTTATTATGCTGACTCCGTTAAAGGTCG
CTTCACTATCTCTAGAGACAACTCTAAGAATACTCTCTACTTGCAGATGA
ACAGCTTAAGGGCTGAGGACACAGCCACATATTACTGTGCGAGAAGACAT
TTCAACGGGGTTGGTTTTGATCTCTGGGGCCAAGGGACAATGGTCACCGT
CTCAAGC 37. 806C-M0046-G12
L-Variable (AA):
(SEQ ID NO: 308)
QDIQMTQSPGTLSLSPGERATLSCRASQSVSSSNLAWYQQKPGQAPRLLI
YGASTRATGIPARFSGSGSGTEFTLTISSLQSEDFAVYYCQLYKTFGGGT
KVEIK L-Variable (DNA):
(SEQ ID NO: 309)
CAAGACATCCAGATGACCCAGTCTCCAGGCACCCTCTCTTTGTCTCCAGG
GGAAAGAGCCACCCTCTCCTGCAGGGCCAGTCAGAGTGTTAGCAGCAGCA
ACTTAGCCTGGTACCAGCAGAAACCTGGCCAGGCTCCCAGGCTCCTCATC
TATGGTGCATCCACCAGGGCCACTCGTATCCCAGCCAGGTTCAGTGGCAG
TGGGTCTGGGACAGACTTCACTCTCACCATCAGCAGCCTGCAGTCTGAAG
ATTTTGCAGTTTATTACTGTCAGCTGTATAAGACTTTCGGCGGAGGCACC
AAGGTGGAGATCAAA H-Variable (AA):
(SEQ ID NO: 310)
EVQLLESGGGLVQPGGSLRLSCAASGFTFSNYKNNWVRQAPGKGLEWVSV
IYPSGGGTYYADSVKGRFTISRDNSKNTLYLQNNSLRAEDTAVYYCARVG
YSSGWFLFYGMDVWGQGTTVTVSS H-Variable (DNA):
(SEQ ID NO: 311)
GAAGTTCAATTGTTAGAGTCTGCTGGCGGTCTTGTTCAGCCTGGTGGTTC
TTTACGTCTTTCTTGCGCTGCTTCCGGATTCACTTTCTCTAATTACAAGA
TGAATTGGGTTCGCCAAGCTCCTGGTAAAGGTTTGGAGTGGGTTTCTGTT
ATCTATCCTTCTGGTGGCGGTACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCTGTGTATTACTGTGCGAGAGTCGGG
TATAGCAGTGGCTGGTTTCTCTTTTACGGTATGGACGTCTGGGCCCAAGG
GACCACGGTCACCGTCTCAAGC 38. 806C-M0046-H03
L-Variable (AA):
(SEQ ID NO: 312)
QSALTQPRSVSGSPCQSVTISCTGSNTDVGRYNFVSWYQQKPGKAPKLII
YDVYKRPSGVPDRFSGSKSGNTASLTISGLQADDEADYYCCSYAEASTFS
YVFGIGTEVTVL L-Variable (DNA):
(SEQ ID NO: 313)
CAGAGCGCTTTGACTCAGCCTCGCTCAGTGTCCGGGTCTCCTGGACAGTC
AGTCACCATCTCCTGCACTGGATCCAATACTGATGTTGGTCGATACAATT
TTGTTTCCTGGTACCAACAAAAGCCAGGCAAAGCCCCCAAACTCATAATT
TATGATGTCTCTATAAGCGGCCCTCAGGGTCCCTGATCGCTTCTCTGGCTC
CAAGTCTGGCAACACGGCCTCCCTGACCATCTCTGGGCTCCAGGCTGACG
ATGAGGCTGATTATTACTGCTGCTCATATGCTCGCGCCTCCACTTTCTCT
TATGTCTTCGGAATTGGGACCGAAGTCACCGTCCTT H-Variable (AA):
(SEQ ID NO: 314)
EVQLLESGGGLVQPGGSLRLSCAASGFTFSSYINVWVRQAPGKGLEWVSS
IYPSGGHTPYADSVKGRETISRDNSKNTLYLQNNSLRAEDTAVYYCARQT
GGYAHFDYWGQGTLVTVSS H-Variable (DNA):
(SEQ ID NO: 315)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACATTA
TGGTTTGGGTTCGCCAAGCTCCTGGTAAAGGTTTGGAGTGGGTTCTTCT
ATCTATCCTTCTGGTGGCCATACTCCTTATGCTGACTCCGTTAAAGGTCG
CTTCACTATCTCTAGAGACAACTCTAAGAATACTCTCTACTTGCAGATGA
ACAGCTTAAGGGCTGAGGACACGCCGTGTATTACTGTGCGAGACAGACG
GGTGGCTACGCCCACTTTGATTACTGGGGCCAGGGAACCCTGGTCACCGT
CTCAAGC 39. 806C-M0046-H10
L-Variable (AA):
(SEQ ID NO: 316)
QDIQMTQSPSSLSASVGDRVTNTCRASQGIGTYLAWYQQKPGKVPKLLIY
AASTLQSGVPSRFSGSGSGTDFTLTISSLQPEDVATYYCQKYNSAPRPFG
QGTQVEIK L-Variable (DNA):
(SEQ ID NO: 317)
CAAGACATCCAGATGACCCAGTCTCCGTCCTCCCTGTCTGCATCTGTAGG
AGACAGAGTCACCATGACTTGCCGGGCGAGTCAGGGCATTGGCACTTATT
TAGCCTGGTATCAGCAGAAACAGGGAAAGTTCCTAAGCTCCTGATCTAT
GCTGCGTCCACTTTGCAATCAGGGGTCCCATCTCGGTTCAGTGGCAGTGG
ATCTGGGACGGATTTCACTCTCACCATCAGCAGCCTGCAGCCTGAAGATG
TTGCAACTTATTACTGTCAAAAGTATAACAGTGCCCCTCGTCCGTTCGGC
CAAGGGACCCAGGTGGAAATCAAA H-Variable (AA):
(SEQ ID NO: 318)
EVQLLESGGGLVQPGGSLRLSCAASGFTFSSYVMHWVRQAPGKGLEWVSS
IYPSGGWTLYADSVKGRFTISRNSKNTLYLQMNSLRAEDTAVYYCARAVG
PFDYWGQGTLVTVSS H-Variable (DNA):
(SEQ ID NO: 319)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACGTTA
TGCATTGGGTTCGCCAAGCTCCTGGTAAAGGTTTGGAGTGGGTTTCTTCT
ATCTATCCTTCTGGTGGCTGGACTCTTTATGCTGACTCCGTTAAAGGTCG
CTTCACTATCTCTAGAGACAACTCTAAGAATACTCTCTACTTGCAGATGA
ACAGCTTAAGGGCTGAGGACACGCCGTGTATTACTGTGCGAGAGCAGTG
GGACCTTTTGACTACTGGGGCCAGGGCACCCTGGTCACCGTCTCAAGC 40. 806C-M0046-H11
L-Variable (AA):
(SEQ ID NO: 320)
QYELIQPPSVSGIPGQRVTISCSGNNSNFGSNTVTWYQQLPGTAPKLLIY
SDSRRPSGVPDRFSGSRSDTSASLAISGLQSEDEAEYHCAAWDDSLNGVF
GGGTKLTVL -continued L-Variable (DNA):
(SEQ ID NO: 321)
CAGTACGAATTGATTCAGCCACCCTCAGTGTCTGGGATCCCCGGACAGAG
GGTCACCATCTCTTGTTCTGGAAACAACTCCAACTTCGGAAGTAATACTG
TAACCTGGTACCAGCAGCTCCCAGGAACGGCCCCCAAACTCCTCATCTAT
AGTGATAGTCGGCGGCCCTCAGGGGTCCCTGACCGATTCTCTGGCTCCAG
GTCTGACACCTCAGCCTCCCTGGCCATCAGTGGGCTCCAGTCTGAGGATG
AGGCTGAGTATCACTGTCAGCATGGGATGACAGCCTAAATGGGGTGTTC
GGCGGAGGGACCAAGCTGACCGTCCTA H-Variable (AA):
(SEQ ID NO: 322)
EVQLLESGGGLVQPGGSLRLSCAASGFTFSRYKMEWVRQAPGKGLEWVSV
IYPSGGHTNYADSVKGRFTISRDNSKNTLYLQMNSLRAEDTAVYYCARGG
YYDILTGYYKYYFDYWGQGTLVTVSS H-Variable (DNA):
(SEQ ID NO: 323)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACAAGA
TGGAGTGGGTTCGCCAAGCTCCTGGTAAAGGTTTGGAGTGGGTTTCTGTT
ATCTATCCTTCTGGTGGCCATACTAATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGGAGGC
TATTACGATATTTTGACTGGTTATTATAAGTACTACTTTGACTACTGGGG
CCAGGGAACCCTGGTCACCGTCTCAAGC 41. 806C-M0047-B03
L-Variable (AA):
(SEQ ID NO: 324)
QDIQMTQSPSPLSASVGDSVTITCRASQRIGSYLNWYQQNPGKAPKLLIY
GASNLESGVPSRFSGRGSGTEFTLTITSLQPEDFATYFCQQTSSVSPLTF
GQGTRLDIK L-Variable (DNA):
(SEQ ID NO: 325)
CAAGACATCCAGATGACCCAGTCTCCATCCCCCCTGTCTGCATCTGTAGG
AGACAGTGTCACCATCACTTGTCGGGCAAGTCAGAGGATTGGCAGCTACT
TGAATTGGTATCAGCAGAATCCAGGCAAAGCCCCAAAACTCCTGATCTAC
GGTGCATCCAATTTGGAAAGTGGGGTCCCATCAAGGTTCAGTGGCCGTGG
ATCTGGGACAGAGTTCACACTCACCATCACCAGTCTGCAACCTGAAGATT
TTGCAACTTATTTCTGTCAACAGACCTCCAGTGTCTCCCCGCTCACCTTC
GGCCAAGGGACACGACTGGACATTAAA H-Variable (AA):
(SEQ ID NO: 326)
EVQLLESGGGLVQPGGSLRLSCAASGFTFSSYKMSWVRQAPGKGLEWVSV
IYPSGGWTYADSVKGRETISRDNSKNTLYLQMNSLRAEDTAVYYCARMM
YYYDSSGYLRADAFDIWGQGTMVTVSS H-Variable (DNA):
(SEQ ID NO: 327)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACAAGA
TGTCTTGGGTTCGCCAAGCTCCTGGTAAAGGTTTGGAGTGGGTTTCTGTT
ATCTATCCTTCTGGTGGCTGGACTTATTATGCTGACTCCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAATGATC
TATTACTATGATAGTAGTGGTTACCTAAGGGCTGATGCTTTTGATATCTG
GGGCCAAGGGACAATGGTCACCGTCTCAAGC 42. 806C-M0047-D01
L-Variable (AA):
(SEQ ID NO: 328)
QDIQMTQSPGTLSTSTGDRVTITCRASQSINEWLAWYQQKPGKAPKLLIY
AASSLQSGVPSRFSGSGSGTDFTLTISRLEPEDFAVYYCQQYGSSPALTF
GGGTKVEIK L-Variable (DNA):
(SEQ ID NO: 329)
CAAGACATCCAGATGACCCACTCTCCAGGCACCCTCTACTATAGG
AGACAGAGTCACCATCACTTGCCGGGCCAGTCAGAGTATTAATGAGTGGT
TGGCCTGGTATCAGCAGAAACCAGGGAAAGCCCCTAAGCTCCTGATCTAT
GCTGCATCCAGTTTGCAAAGTGGGGTCCCATCAAGGTTCAGTGGCAGTGC
ATCTGGGACAGACTTCACTCTCACCATCAGCAGACTGGAGCCTGAAGATT
TTGCAGTGTATTACTGTCAGCAGTATGGTAGCTCACCCGCGCTCACTTTC
GGCGGAGCGACCAAGGTGGAGATCAAA H-Variable (AA):
(SEQ ID NO: 330)
EVQLLESGGGLVQPGGSLRLSCAASGFTFSAYKMMWVRQAPGKGLEWVSS
IYPSGGWTYYADSVKGRFTISRDNSKNTLYLQNNSLRAEDTALYYCARSM
GYGDAFDIWGQGTMVTVSS H-Variable (DNA):
(SEQ ID NO: 331)
GAAGTTCAATTGTTAGAGTCTGGTGGCGGTCTTGTTCAGCCTGGTGGTTC
TTTACGTCTTTCTTGCGCTGCTTCCGGATTCACTTTCTCTGCTTACAAGA
TGATGTGGGTTCGCCAAGCTCCTGGTAAAGGTTTGGAGTGGGTTTCTTCT
ATCTATCCTTCTGGTGGCTGGACTTATTATGCTGACTCCGTTAAAGGTCG
CTTCACTATCTCTAGAGACAACTCTAAGAATACTCTCTACTTGCAGATGA
ACAGTTTAAGGGCTGAGGACACCGCCTTGTATTACTGTGCGAGATCAATG
GGCTATGGTGATGCTTTTGATATCTGGGGCCAAGGGACAATGGTCACCGT
CTCAAGC 43. 806C-M0047-D03
L-Variable (AA):
(SEQ ID NO: 332)
QDIQMTQSPSSLSASVGDRVTITCRASQTIRSYLNWYQQKPGKAPKLLIY
AASNLQSGVPSRFSGSGSGTDFTLTISSLQPEDFATYYCQQSYSMSSWTF
GQGTNLEIK L-Variable (DNA):
(SEQ ID NO: 333)
CAAGACATCCAGATGACCCACTCTCCATCCTCCCTCTCTGCATCTGTAGG
AGACAGAGTCACAATCACTTGCCGGGCAAGTCAGACCATTAGAAGCTATT
TAAATTGGTATCAGCACAAACCAGGGAAAGCCCCTAAGCTCCTGATCTAT
GCTGCATCCAATTTGCAAAGTGGGGTCCCATCAAGCTTCAGTGGCAGTGG
GTCTGGGACAGACTTCACTCTCACCATCAGCAGTCTGCAACCTGAAGATT
TTGCAACTTACTACTGTCAACAGAGTTACAGTATGTCGTCGTGGACTTTT
GGCCAGGGGACCAACCTGGAGATCAAA H-Variable (AA):
(SEQ ID NO: 334)
EVQLLESGGGLVQPGGSLRLSCAASGFTFSVYPMAWVRQAPGKGLEWVSW
ISPGGKTYYADSVKGRFTISRDNSKNTLYLQMNSLRAEDTATYYCARGSR
RYDKFDYWGQGTLVTVSS H-Variable (DNA):
(SEQ ID NO: 335)
GAAGTTCAATTGTTAGAGTCTGGTGGCGGTCTTGTTCAGCCTGGTGGTTC
TTTACGTCTTTCTTGCGCTGCTTCCGGATTCACTTTCTCTGTTTACCCTA
TGGCTTGGGTTCGCCAAGCTCCTGGTAAAGGTTTGGAGTGGGTTTCTTGG
ATCTCTCCTGGTGGCAAGACTTATTATGCTGACTCCGTTAAAGGTCGCTT
CACTATCTCTAGAGACAACTCTAAGAATACTCTCTACTTGCAGATGAACA
GCTTAAGGGCTGAGGACACAGCCACGTATTACTGTGCGAGAGGGAGCCGC
CACTATGATAAGTTTGACTACTGGGGCCAGGGAACCCTGCTCACCGTCTC
AAGC 44. 806C-M0047-E10
L-Variable (AA):
(SEQ ID NO: 336)
QSVLTQPASVSGSPGQSITISCTGTSSDVGGYNYVSWYQQHPGKAPKVMI
YDVSNRPSGVSNRFSGSKSGNTASLTISGLLAEDEADYYCSSYTSTATYV
LGTGTRVTVV L-Variable (DNA):
(SEQ ID NO: 337)
CAGAGCGTCTTGACTCAGCCTGCCTCCGTGTCTGGGTCTCCTGGACAGTC
GATCACCATCTCCTGCACTGGAACCAGCAGTGACGTTGGTGGTTACAACT
ATGTCTCCTGGTACCAACAACACCCAGGCAAAGCCCCCAAAGTCATGATT
TATGATGTCAGTAATCGGCCCTCAGGGGTTTCTAATCGCTTCTCTGGCTC
CAAGTCTGGCAACACGGCCTCCCTGACCATCTCGGGGCTCCTGGCTGAGG
ACGAAGCTGATTATTACTGCAGCTCATATACAACTACAGCCACCTATGTC
CTCGGAACTGGGACCAGGCTCACCGTCGTA H-Variable (AA):
(SEQ ID NO: 338)
EVQLLESGGGLVQPGCSLRLSCAASGFTFSHYKNAWVRQAPGKGLEWVSV
IYPSGGATYYADSVKGRFTISRDNSKNTLYLQNNSLRAEDTAVYYCARAL
PGGYFDYWGQGTLVTVSS H-Variable (DNA):
(SEQ ID NO: 339)
GAAGTTCAATTGTTAGAGTCTGGTGGCGGTCTTGTTCAGCCTGGTGGTTC
TTTACGTCTTTCTTCCGCTGCTTCCGGATTCACTTTCTCTCATTACAAGA
TGGCTTGGGTTCGCCAAGCTCCTGGTAAAGGTTTGGAGTGGCTTTCTGTT
ATCTATCCTTCTGGTGGCGCTACTTATTATGCTGACTCCGTTAATGGTCG 45. 806C-M0047-G09
L-Variable (AA):
(SEQ ID NO: 340)
QDIQMTQSPGTLSLSPGERATLACRASQSVSSSYLAWYQQKPGQAPRLLI
YGASNRATGIPDRFSGSGSDTDFTLKISRVEAEDVGTYYCMQATFWPYAF
GQGTKLEIK L-Variable (DNA):
(SEQ ID NO: 341)
CAAGACATCCAGATCACCCAGTCTCCAGGCACCCTGTCTTTGTCTCCAGG
GGAAAGAGCCACCCTCGCCTGCAGGGCCAGTCAGAGTGTTAGCAGCAGCT
ACTTAGCCTGGTACCAGCAGAAACCTGGCCAGGCTCCCAGGCTCCTCATC
TATGGTGCATCCAACAGGGCCACTGGCATCCCAGACAGATTCAGCGGCAG
TGGGTCAGACACTGATTTCACACTGAAAATCAGCAGGGTGGAGGCTGAGG
ATGTTGGGACTTATTACTGCATGCAAGCTACATTCTGGCCCTACGCTTTT
GGCCAGGGGACCAAGCTGGAGATCAAA H-Variable (AA):
(SEQ ID NO: 342)
EVQLLESGGGLVQPGGSLRLSCAASGFTFSWYRIYIVWWRQAPGKGLEWV
SGIYPSGGFTSYADSVKGRFTISRDNSKNTLYLQMNSLRAEDTAVYYCAR
VYYYDSSGYYFRGGFDPWGQGTLVTVSS H-Variable (DNA):
(SEQ ID NO: 343)
GAAGTTCAATTGTTAGAGTCTGGTGGCGGTCTTGTTCAGCCTGGTGGTTC
TTTACGTCTTTCTTGCGCTGCTTCCGGATTCACTTTTCTTGGTACCGTA
TGGTTTGGGTTCGCCAAGCTCCTGGTAAAGGTTTGGAGTGGGTTTCTGGT
ATCTATCCTTCTGGTGGCTTTACTTCTTATGCTGACTCCGTTAAAGGTCG
CTTCACTATCTCTAGAGACAACTCTAAGAATACTCTACTTGCAGATGA
ACAGCTTAAGGGCTGAGGACACGGCCGTGTATTACTGTGCGAGAGTGTAT
TACTATGATAGTAGTGGTTATTATTTCCGTGGGGGGTTCGACCCCTGGGG
CCAGGGCACCCTGGTCACCGTCTCAACC 46. 806C-M0053-A02
L-Variable (AA):
(SEQ ID NO: 344)
QSVLTQPPSVSGIPGQRVTISCSGNNSNFGSNTVTWYQQLPGTAPKLLIY
SDSRRPSGVPDRFSGSRSDTSASLAISGLQSEDEAEYHCAAWDDSLNGVF
GGGTKLTVL L-Variable (DNA):
(SEQ ID NO: 345)
CAGAGCGTCTTGACTCAGCCACCCTCACTGTCTGGGATCCCCGGACAGAG
GGTCACCATCTCTTGTTCTGGAAACAACTCCAACTTCGGAAGTAATACTG
TAACCTGGTACCAGCAGCTCCCAGGAACGGCCCCCAAACTCCTCATCTAT
AGTGATAGTCGGCGGCCCTCAGGGGTCCCTGACCGATTCTCTGGCTCCAG
GTCTGACACCTCAGCCTCCCTGGCCATCAGTGGGCTCCAGTCTGAGGATG
AGGCTGAGTATCACTGTGCAGCATGGGATGACAGCCTAAATGGGGTGTTC
GGCGGAGGGACCAAGCTGACCCTCCTA H-Variable (AA):
(SEQ ID NO: 346)
EVQLLESGGGLVQPGGSLRLSCAASGFTFSQYLMQWVRQAPGKGLEWVSS
IYPSGGATYYADSVKGRETISRDNSKNTLYLQMNSLRAEDTAVYYCATRK
DGYSRSAFDIWGQGTNVTVSS H-Variable (DNA):
(SEQ ID NO: 347)
GAAGTTCAATTGTTAGAGTCTGGTGGCGGTCTTGTTCAGCCTGGTGGTTC
TTTACGTCTTTCTTGCGCTGCTTCCGGATTCACTTTTCTCTCAGTACCTTA
TGCAGTGGGTTCGCCAAGCTCCTGCTAAAGGTTTGGAGTGGGTTTCTTCT
ATCTATCCTTCTGGTGCGCTACTTATTATGCTGACTCCGTTAAAGGTCG
CTTCACTATCTCTAGAGACAACTCTAAGAATACTCTACTTGCAGATGA
ACAGCTTAAGGGCTGAGGACACGGCCGTGTATTACTGTGCAACAAGGAAG
GATGGCTACAGTCGAAGTGCTTTTCATATCTGGGGCCAAGGGACAATGGT
CACCGTCTCAAGC 47. 806C-M0053-A03
L-Variable (AA):
(SEQ ID NO: 348)
QDIQMTQSPGTLSLSPGERATLSCRASQSVSSSYLAWYQQKPGQAPRLLI
YGASSRATGIPDRFSGSGSDTDFTLTISRLEPEDFAVYYCQQRGNWPRTF
GQGTKVEIK L-Variable (DNA):
(SEQ ID NO: 349)
CAAGACATCCAGATGACCCAGTCTCCAGGCACCCTGTCTTTGTCTCCAGG
GGAAAGAGCCACCCTCTCCTGCAGGGCCAGTCAGAGTGTTAGCAGCAGCT
ACTTAGCCTGGTACCAGCAGAAACCTGGCCACGCTCCCAGGCTCCTCATC
TATGGTGCATCCAGCAGGGCCACTGGCATCCCAGACAGGTTCAGTGGCAG
TGGGTCTGGGACAGACTTCACTCTCACCATCAGCAGACTGGAGCCTGAAG
ATTTTGCAGTGTATTACTGTCAGCAGCGTGGCAACTGGCCCCGGACGTTC
GGCCAAGGGACCAAGGTGGAAATCAAA H-Variable (AA):
(SEQ ID NO: 350)
EVQLLESGGGLVQPGGSLRLSCAASGFTFSHYVNWWVRQAPGKGLEWVSG
IYPSGWTVYADSVKGRFTISRDNSKNTLYLQMNSLRAEDTAVYYCAKDLG
GTRAFDYWGQGTLVTVSS H-Variable (DNA):
(SEQ ID NO: 351)
GAAGTTCAATTGTTAGAGTCTGGTCGCGGTCTTGTTCAGCCTGGTGGTTC
TTTACGTCTTTCTTGCGCTGCTTCCGGATTCACTTTCTCTCATTACGTTA
TGTGGTGGGTTCGCCAAGCTCCTGGTAAAGGTTTGGAGTGGGTTTCTGGT
ATCTATCCTTCTGGTTGGACTGTTTATGCTGACTCCGTTAAAGGTCGCTT
CACTATCTCTAGAGACAACTCTAAGAATACTCTACTTGCAGATGAACA
GCTTAAGGGCTGAGGACACGGCCGTGTATTACTGTGCGAAAGATCTGGGG
GGGACCCGTGCCTTTGACTACTGGGGCCAGGGAACCCTGGTCACCGTCTC
AAGC 48. 806C-M0053-A05
L-Variable (AA):
(SEQ ID NO: 352)
QSELTQPASVSGSPGQSITISCTGTSSDDVGGYNYVSWYQQHPGKAPKLL
IYDVSDRPSGVSNRFSGSKSGNTASLTISGLLAEDEADYYCGSYRVTSVS
RSYVFGTETK L-Variable (DNA):
(SEQ ID NO: 353)
CAGAGCGAATTGACTCAGCCTGCCTCCGTGTCTGGGTCTCCTGGACAGTC
GATCACCATCTCCTGCACTGGAACCAGCAGTGACGACGTTGGTGGTTATA
ACTATGTCTCCTGGTACCAACAACACCCAGGCAAAGCCCCCAAACTCCTG
ATTTATGATGTCAGTGATCGGCCCTCAGGGGTTTCTAATCGCTTCTCTGG
CTCCAAGTCTGGCAACACGGCCTCCCTGACCATCTCTGCGCTCCTGGCTG
AGGACGAGGCTGATTATTATTGCGGCTCATATCCCGTCACCAGCGTCAGC
AGATCCTATGTCTTCGGAACTGAGACCAAG H-Variable (AA):
(SEQ ID NO: 354)
EVQLLESGGGLVQPGGSLRLSCAASGFTFSNYPMTWVRQAPGKGLEWVSR
IYPSGGYTYYADSVKGRFTTSRDNSKNTLYLQNNSLRAEDTAVYYCARGR
IAALDYWGQGTLVTVSS H-Variable (DNA):
(SEQ ID NO: 355)
GAAGTTCAATTGTTACAGTCTGGTGGCGGTCTTGTTCAGCCTGGTGGTTC
TTTACGTCTTTCTTGCGCTGCTTCCGGATTCACTTTCTCTAATTACCCTA
TGACTTGGGTTCGCCAAGCTCCTGGTAAAGGTTTGGAGTGGGTTTCTCGT
ATCTATCCTTCTGGTATACTTATTATGCTGACTCCGTTAAAGGTCG
CTTCACTATCTCTAGAGACAACTCTAAGAATACTCTACTTGCAGATGA
ACAGCTTAAGGGCTGAGGACACGGCCGTGTATTACTGTGCGAGGGGTCGT
ATAGCAGCTCTTGACTACTGGGGCCAGGGCACCCTGGTCACCGTCTCAAG
C 49. 806C-M0053-A09
L-Variable (AA):
(SEQ ID NO: 356)
QSALTQPTVSVALGQTVRITCQGDTLRYFSASWYQQKPGQAPVLIFGA
NNRPSGIPDRFSGSRSGVTASLTITGAQAEDEAEYYCNSRDGSGNWLFGG
GTKLSVL L-Variable (DNA):
(SEQ ID NO: 357)
CAGAGCGCTTTGACTCAGGGCCCTACTGTGTCTGTGGCCTTGGGACAGAC
AGTCAGGATCACATGTCAAGGAGACACCCTCAGATACTTTTCTGCAAGTT
GCTACCAGCAGAAGCCGGGACAGGCCCCTGTCCTTGTCATCTTTGGGGCA
AACAATCGGCCCTCAGGGATCCCAGACCGGTTCTCTGGCTCCAGGTCAGG
AGTCACCGCTTCCTTGACCATCACTGGGGCTCAGGCGGAAGATGAGGCTG
AGTATTACTGTAACTCCCGGGACGGCAGTGGTAATTGGCTGTTCGGCGGA
GGGACCAAGCTGTCCGTCCTC -continued H-Variable (AA):
(SEQ ID NO: 358)
EVQLLESGGGLVQPGGSLRLSCAASGFTFSRYVMHWVRQAPGKGLEWVSV
IYPSGGATLYADSVKGRFTISRDNSKNTLYLQNNSLRAEDTAVYYCARGQ
YSSGWYTEGWFDPWGQGTLVTVSS H-Variable (DNA):
(SEQ ID NO: 359)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACGTTA
TGCATTGGGTTCGCCAAGCTCCTGGTAAACGTTTGGAGTGGGTTTCTGTT
ATCTATCCTTCTGGTGGCGCTACTCTTTATGCTGACTCCGTTAAAGGTCG
CTTCACTATCTCTAGAGACAACTCTAAGAATACTCTCTACTTGCACATGA
ACAGCTTAAGGGCTGAGGACACGCCGTGTATTACTGTGCGAGAGGCCAG
TATAGCAGTGGCTGGTACACGGAGGGCTGGTTCGACCCCTGGGGCCAGGG
CACCCTGGTCACCGTCTCAAGC 50. 806C-M0053-B09
L-Variable (AA):
(SEQ ID NO: 360)
QYELTQPPSASGTPGQRVTISCSGSSSNIGSNNVNWYQQLPGTAPKLLIY
SNDQRPSGVPDRFSGSKSATSASLAISGLQSEDEADYHCAAWDDSLNGPV
FGGGTKLTVL L-Variable (DNA):
(SEQ ID NO: 361)
CAGTACGAATTGACTCAGCCACCCTCAGCGTCTGGGACCCCCGGGCAGAG
GGTCACCATCTCTTGTTCTGGAAGCAGCTCCAACATCGGAAGTAATAATG
TCAACTGGTACCAGCAACTCCCAGGAACGGCCCCCAAACTCCTCATCTAC
AGTAATGATCAGCGGCCCTCAGGGGTCCCTGACCGATTCTCTGGCTCCAA
GTCTGCCACCTCAGCCTCCCTGGCCATCAGTGGGCTCCAGTCTGAGGATG
AGGCTGATTATCACTGTGCAGCATGGGATGACAGCCTGAATGGTCCGGTG
TTCGGCGGAGGGACCAAGCTGACCGTCCTA H-Variable (AA):
(SEQ ID NO: 362)
EVQLLESGGGLVQPGGSLRLSCAASGFTFSRYKNQWVRQAPGKGLEWVSS
IYPSGGITYYADSVKGRETISRDNSKNTLYLQMNSLRAEDTAVYYCARGR
GTTRAFDYWGQGTLVTVSS H-Variable (DNA):
(SEQ ID NO: 363)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACAAGA
TGCAGTGGGTTCGCCAAGCTCCTGGTAAAGGTTTGGAGTGGGTTTCTTCT
ATCTATCCTTCTGGTGGCATTACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCGTGTATTACTGTCCGAGAGGACGA
GGAACGACGCGGGCTTTTGACTACTGGGGCCAGGGAACCCTGGTCACCGT
CTCAAGC 51. 806C-M0053-B11
L-Variable (AA):
(SEQ ID NO: 364)
QYELTQPPSVSVAPGQTAKILCGGNDIGRKFVHWYQQKPGQAPVLVVFDD
SDRPSGIPERFSGSNSGSTATLTISGVEAGDEADYFCQVWDLSSDHWVPG
GGTKLTVL L-Variable (DNA):
(SEQ ID NO: 365)
CAGTACGAATTGACTCAGCCACCCTCGGTGTCAGTGGCCCCAGGACAGAC
GGCCAAGATTCTCTGTGGGGGAAACGACATTGGAAGAAAGTTTGTTCACT
GGTACCAGCAGAAGCCAGGCCAGGCCCCTGTGCTGGTCGTCTTTGATGAT
AGCGACCGGCCCTCAGGGATCCCTGAGCGATTCTCTGGCTCCAATTCTGG
GAGCACGGCCACCCTGACCATCAGCGGGGTCGAAGCGGGGATGAGGCCG
ACTATTTCTGTCAGGTGTGGGATCTTAGTAGTGATCATTGGGTGTTCGGC
GGAGGGACCAAGCTGACCGTCCTA H-Variable (AA):
(SEQ ID NO: 366)
EVQLLESGGGLVQPGGSLRLSCAASCFTFSDYAMHWVRQAPGKGLEWVSR
IGSSGGHTSYADSVKGRFTISRDNSKNTLYLQMNSLRAEDTANYYCATDY
YYDSSGYYYPAFDIWGQGTMVTVSS H-Variable (DNA):
(SEQ ID NO: 367)
GAAGTTCAATTGTTAGAGTCTGGTGGCGGTCTTGTTCAGCCTGGTGGTTC
TTTACGTCTTTCTTGCGCTGCTTCCGGATTCACTTTCTCTGATTACGCTA
TGCATTGGGTTCGCCAAGCTCCTGGTAAAGGTTTGGAGTGGGTTTCTCCT
ATCGGTTCTTCTGGTGGCCATACTTCTTATGCTGACTCCGTTAAAGGTCG
CTTCACTATCTCTAGAGACAACTCTAAGAATACTCTCTACTTGCAGATGA
ACAGCTTAAGGGCTCAGGACACCGCCATGTATTACTGTGCGACTGACTAT
TACTATGATAGTAGTGGTTATTACTACCCTGCTTTTGATATCTGGGGCCA
AGGGACAATGGTCACCGTCTCAACC 52. 806C-M0053-D03
L-Variable (AA):
(SEQ ID NO: 368)
QDIQMTQSPGTLSLSPGERATLSCRASQSVSSSYLAWYQQKPGQAPRLLI
YGASSRATGIPDRFSGSGSGTDFTLTISRLEPEDFAVYYCQQYGSSPLFG
GGTKVEIK L-Variable (DNA):
(SEQ ID NO: 369)
CAAGACATCCAGATGACCCAGTCTCCAGGCACCCTGTCTTTGTCTCCAGG
GGAAAGAGCCACCCTCTCCTGCAGGGCCAGTCAGAGTGTTAGCAGCAGCT
ACTTAGCCTGGTACCAGCAGAAACCTGGCCAGGCTCCCAGGCTCCTCATC
TATGGTGCATCCAGCAGGGCCACTGGCATCCCAGACAGGTTCAGTGGCAG
TGGGTCTGGGACAGACTTCACTCTCACCATCAGCAGACTGGAGCCTGAAG
ATTTTGCAGTGTATTACTGTCAGCAGTATGGTAGCTCACCTCTGTTCGGC
GGAGGGACCAAGCTGGAGATCAAA H-Variable (AA):
(SEQ ID NO: 370)
EVQLLESGGGLVQPGGSLRLSCAASGFTFSRYAIVIMWVRQAPGKGLEWV
SSIYPSGGSTYYADSVKGRFTISRDNSKNTLYLQMNSLRAEDTAVYYCAR
VQGGAGAFDIWGQGTMVTVSS H-Variable (DNA):
(SEQ ID NO: 371)
GAACTTCAATTGTTACAGTCTGGTGGCGGTCTTGTTCAGCCTGGTGGTTC
TTTACCTCTTTCTTGCGCTGCTTCCGGATTCACTTTCTCTCGTTACGCTA
TGATGTGGGTTCGCCAAGCTCCTGGTAAAGGTTTGGAGTGGGTTTCTTCT
ATCTATCCTTCTGGTGGCTCTACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGCCGTGTATTACTGTGCGAGAGTACAG
GGGGGGGCGGGTGCTTTTGATATCTGGGGCCAAGGGACAATGGTCACCGT
CTCAAGC 53. 806C-M0053-D06
L-Variable (AA):
(SEQ ID NO: 372)
QDIQMTQSPSSLSASVGDRVTITCRASQSINTYLNWYQHKPGKAPELLIS
AASSLQSGVPSRFSGSGSGTDFTLTISSLRPEDFATYYCQQSHSISTFTF
GPGTKVDVK L-Variable (DNA):
(SEQ ID NO: 373)
CAAGACATCCAGATGACCCAGTCTCCATCTTCCCTGTCTGCATCTGTCGG
AGACAGAGTCACCATCACTTGCCGGCAAGTCAGAGCATTAACACGTATT
TAAATTGGTATCAGCACAAACCAGGGAAGGCCCCTGAGCTCCTGATCTCT
GCTGCATCTAGCTTGCAAAGTGGGGTCCCATCAAGGTTCAGTGGCAGTGG
ATCTGGGACAGATTTCACTCTCACCATCAGCAGTCTGCGACCTGAAGATT
TTGCGACTTACTACTGTCAACAGAGTCACAGTATATCCACATTCACTTTC
GGCCCTGGGACCAAAGTGGATGTCAAG H-Variable (AA):
(SEQ ID NO: 374)
EVQLLESGGGLVQPGGSLRLSCAASGFTFSRYKMHWXTRQAPGKGFEWVS
SIVPSGGWTYYADSVKGRFTISRDNSKNTLYLQNNSLRAEDTAVYYCARQ
MYYYDSSGYYVGRFDIWGQGTTVTVSS H-Variable (DNA):
(SEQ ID NO: 375)
GAAGTTCAATTCTTAGAGTCTGGTGGCGGTCTTGTTCAGCCTGGTGGTTC
TTTACGTCTTTCTTGCGCTGCTTCCGGATTCACTTTCTCTCGTTACAAGA
TGCATTGGGTTCGCCAAGCTCCTGGTAAAGGTTTGGAGTGGGTTTCTTCT
ATCGTTCCTTCTGGTGGCTGGACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGCCGTGTATTACTGTGCGAGACAAATG
TATTACTATGATAGTACTGGTTATTATGTCGGGCGTTTTCATATCTGGGG
CCAAGGGACCACGGTCACCGTCTCAAGC 54. 806C-M0053-D12
L-Variable (AA):
(SEQ ID NO: 376)
QDIQMTQSPATLSLSPCERATLSCRASQSVSSYLAWYQQKPGQAPRLLIY
DASNRATGIPARFSGSGSGTDFTLTISSLEPEDFAVYYCQQRSNWPPRIT
FGGGTKVEIK -continued L-Variable (DNA):
(SEQ ID NO: 377)
CAAGACATCCAGATGACCCAGTCTCCAGCCACCCTGTCTTTGTCTCCAGG
GGAAAGAGCCACCCTCTCCTGCAGGGCCAGTCAGAGTGTTAGCAGCTACT
TAGCCTGGTACCAACAGAAACCTGGCCAGGCTCCCAGGCTCCTCATCTAT
GATGCATCCAACAGGGCCACTGGCATCCCAGCCAGGTTCAGTGGCAGTGG
GTCTGGGACAGACTTCACTCTCACCATCAGCAGCTAGAGCCTGAAGATT
TTGCAGTTTATTACTGTCAGCAGCGTAGCAACTGGCCTCCCCGGATCACT
TTCGGCGGAGGGACCAAGGTGGAGATCAAA H-Variable (AA):
(SEQ ID NO: 378)
EVQLLESGGGLVQPGGSLRLSCAASGFTFSSYMMFWVRQAPGKGLEWVSR
IYPSGGWTYYADSVKGRFTISRDNSKNTLYLQMNSLRAEDTAVYYCARVT
VPLDSGSYYFDYWGQGTLVTVSS H-Variable (DNA):
(SEQ ID NO: 379)
GAAGTTCAATTGTTAGAGTCTCGTGGCGGTCTTGTTCAGCCTGGTGGTTC
TTTACCTCTTTCTTGCGCTGCTTCCGGATTCACTTTCTCTTCTTACATGA
TGTTTTGGGTTCGCCAAGCTCCTGGTAAAGGTTTGGAGTGGGTTTCTCGT
ATCTATCCTTCTGTGGCTGGACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGTTACG
GTACCCCTTGATAGTGGGAGCTACTACTTTGACTACTGGGGCCAGGGAAC
CCTGGTCACCGTCTCAAGC 55. 806C-M0053-E03
L-Variable (AA):
(SEQ ID NO: 380)
QDIQMTQSPATLSLSPGERATLSCRASQSVSSSYLAWYQQKPGQAPRLLI
YGASSRATGIPDRFSGSGSGTDFTLTISRLEPEDFAVYYCQQYGSSPQLT
FGGGTKVEIK L-Variable (DNA):
(SEQ ID NO: 381)
CAAGACATCCAGATGACCCAGTCTCCAGCCACCCTGTCTTTGTCTCCAGG
GGAAAGAGCCACCCTCTCCTGCAGGGCCAGTCAGAGTGTTAGCAGCAGCT
ACTTAGCCTGGTACCAGCAGAAACCTGGCCAGGCTCCCAGGCTCCTCATC
TATGGTGCATCCAGCAGGGCCACTGGCATCCCAGACAGGTTCAGTGGCAG
TGGGTCTGGGACAGACTTCACTCTCACCATCAGCAGACTGGAGCCTGAAG
ATTTTGCAGTGTATTACTGTCAGCAGTATGGTAGCTCACCCCAGCTCACT
TTCGGCGGAGGGACCAAGGTGGAGATCAAA H-Variable (AA):
(SEQ ID NO: 382)
EVQLLESGGGLVQPGGSLRLSCAASGFTFSNYKNWWVRQAPGKGLEWVSS
TYPSGGWTQYADSVKGRFTISRDNSKNTLYLQMNSLRAEDTAVYYCAKDV
GGGGFDYWGQGTLVTVSS H-Variable (DNA):
(SEQ ID NO: 383)
GAAGTTCAATTGTTAGAGTCTGGTGGCGGTCTTGTTCAGCCTGGTGGTTC
TTTACGTCTTTCTTGCGCTGCTTCCGGATTCACTTTCTCTAATTACAAGA
TGTGGTGGGTTCGCCAAGCTCCTGGTAAAGGTTTGCAGTGGGTTTCTTCT
ATCTATCCTTCTGGTGGACTCAGTATGCTGACTCCGTTAAAGGTCG
CTTCACTATCTCTAGAGACAACTCTAAGAATACTCTCTACTTGCAGATGA
ACAGCTTAAGGGCTGAGGACACTGCCGTGTATTACTGTGCGAAAGATGTT
GGGGGGGGTGGCTTTGACTACTGGGGCCAGGGAACCCTGGTCACCGTCTC
AAGC 56. 806C-M0053-E04
L-Variable (AA):
(SEQ ID NO: 384)
QDIQMTQSPATLSVSPGERATLSCRASQSVSSNLAWYQQKPGQAPRLLIY
GASTRATGIPARFSGSGSGTEFTLTISSLQSEDFAVYYCLTRVTFGGCTK
VELK L-Variable (DNA):
(SEQ ID NO: 385)
CAAGACATCCAGATGACCCAGTCTCCAGCCACCCTGTCTGTCTCTCCAGG
GGAAAGAGCCACCCTCTCCTGCAGGGCCAGTCAGAGTGTTAGCAGCAACT
TAGCCTGGTACCAGCAGAAACCTGGCCAGGCTCCCAGGCTCCTCATCTAT
GGTGCATCCACCAGGGCCACTGGTATCCCAGCCAGGTTCAGTGGCAGTGG
GTCTGGGACAGAATTCACTCTCACCATCAGCAGCCTGCAGTCTGAAGATT
TTGCAGTTTATTACTGTCTAACACGAGTCACTTTCGGCGGAGGGACCAAG
GTTGAGCTCAAG H-Variable (AA):
(SEQ ID NO: 386)
EVQLLESGGGLVQPGGSLRLSCAASGFTFSHYKNGWVRQAPGKGLEWVSS
IYPSGGWTTYADSVKGRFTISRDNSKNTLYLQNNSLRAEDTAVYYCARDS
PLWPAAIKSGAYYYGMDVWGQGTTVTVSS H-Variable (DNA):
(SEQ ID NO: 387)
GAAGTTCAATTGTTAGAGTCTGGTGGCGGTCTTGTTCAGCCTGGTGGTTC
TTTACGTCTTTCTTGCGCTCCTTCCGGATTCACTTTCTCTCATTACAAGA
TGGGTTGGGTTCGCCAAGCTCCTGGTAAAGCTTTGGAGTGGGTTTCTTCT
ATCTATCCTTCTGGTGGCTGGACTACTTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGATTCC
CCCCTAGTAGTACCAGCTGCTATTAAGAGCGCGGCCTACTACTACGGTAT
GGACGTCTGGGGCCAAGGCACCACGGTCACCGTCTCAACC 57. 806C-M0053-E08
L-Variable (AA):
(SEQ ID NO: 388)
QSVLTQPPSASGTPGQRVSISCSGSSYNIGVYDVYWYQQLPGTAPKLLIY
TNNQRPSGVPDRFSGSKSGTSASLSISGLRSEDEADYYCAAWDDSLAGWV
FGGGTKVTVL L-Variable (DNA):
(SEQ ID NO: 389)
CAGAGCGTCTTGACTCAGCCACCCTCAGCGTCTGGGACCCCGGGCAGAG
GGTCAGTATCTCTTGTTCTGGAAGCAGCTACAACATCGGAGTTTATGATG
TATACTGGTACCAGCAGCTCCCAGGAACGGCCCCAAACTCCTCATCTAT
ACCAATAATCAGCGCCCTCAGGGGTCCCTGACCGATTCTCTGGCTCCAA
GTCTGGCACCTCAGCCTCCCTGTCCATCAGTGGGCTCCGGTCCGAGGATG
AGGCTGATTATTACTGTGCAGCCTGGGATGACAGCCTGGCTGGTTGGGTG
TTCGGCGGAGGGACCAAGGTGACCGTCCTA H-Variable (AA):
(SEQ ID NO: 390)
EVQLLESGGGLVQPGGSLRLSCAASGFTFSRYVMLWVRQAPGKGLEWVSV
IYPSGGYTYYADSVKGRFTISRDNSKNTLYLQMNSLRAEDTAVYYCARGV
LRAFDIWGQGTNVTVSS H-Variable (DNA):
(SEQ ID NO: 391)
GAAGTTCAATTGTTAGAGTCTGGTGGCGGTCTTGTTCAGCCTGGTGGTTC
TTTACGTCTTTCTTGCGCTGCTTCCGGATTCACTTTCTCGTTACGTTA
TGCTTTGGGTTCGCCAAGCTCCTGGTAAAGGTTTGGAGTGGGTTTCTGTT
ATCTATCCTTCTGGTGGCTATACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGGGGTA
CTAAGAGCTTTTGATATCTGGGGCCAAGGGACAATGGTCACCGTCTCAAG
C 58. 806C-M0053-F04
L-Variable (AA):
(SEQ ID NO: 392)
QDIQMTQSPATLSLSPGERATLSCRASQSVSSYLAWYQQKPGQAPRLLIY
DTSNRATGIPARFSGSGSGTDFTLTISSLEPEDFAVYYCQQRSNWPITFG
QGTRLEIK L-Variable (DNA):
(SEQ ID NO: 393)
CAAGACATCCAGATGACCCAGTCTCCAGCCACCCTGTCTTTGTCTCCGGG
GGAAAGAGCCACCCTCTCCTGCAGGGCCAGTCAGAGTGTTAGCAGCTACT
TAGCCTGGTACCAACAGAAACCTGGCCAGGCTCCCAGGCTCCTCATCTAT
GATACATCCAACAGGGCCACTGGCATCCCAGCCAGGTTCAGTGGCAGTGG
GTCTGGGACAGACTTCACTCTCACCATCAGCAGTCTAGAGCCTGAAGATT
TTGCAGTTTATTACTGTCAGCAGCGTAGCAACTGGCCGATCACCTTCGGC
CAAGGGACACGACTGGAGATTAAA H-Variable (AA):
(SEQ ID NO: 394)
EVQLLESGGGLVQPGGSLRLSCAASGFTFSGYGNYWVRQAPGKGLEWVSV
ISPSGGYTHYADSVKGRETISRDNSKNTLYLQNNSLRAEDTAVYYCARAY
SSGWYLDYWGQGTLVTVSS H-Variable (DNA):
(SEQ ID NO: 395)
GAAGTTCAATTGTTAGAGTCTGGTGGCGGTCTTGTTCAGCCTGGTGGTTC
TTTACGTCTTTCTTGCGCTGCTTCCGGATTCACTTTCTCTGGTTACGGTA
TGTATTGGGTTCGCCAAGCTCCTGGTAAAGGTTTGGAGTGGGTTTCTGTT
ATCTCTCCTTCTGGTGGCTATACTCATTATGCTGACTCCGTTAAAGGTCG

59. 806C-M0053-F05
L-Variable (AA):

(SEQ ID NO: 396)
QSVLTQPPSLSVSPGQTARIACSGDNLGSRYISWYQQKSGQSPVVVLYQD
YRRPSGIPERISGSNSGNTATLTISGTQAXTDEADYYCQAWDRSTAVFGG
GTRLTVL

L-Variable (DNA):

(SEQ ID NO: 397)
CAGAGCGTCTTGACTCAGCCACCCTCACTGTCCGTGTCCCCAGGGCAGAC
AGCCCGCATCGCCTGCTCTGGAGATAATTTGGGGAGTAGATATATTTCCT
GGTATCAGCAGAAGTCAGGCCAGTCTCCTGTGGTGGTCCTCTATCAAGAT
TACAGACGGCCCTCAGGGATCCCTGAGCGAATCTCTGGCTCCAACTCTGG
GAACACAGCCACTCTGACCATCAGCGGGACTCAGGCTGTGGATGAGGCGG
ACTATTATTGTCAGGCGTGGGACAGAAGCACTGCGGTGTTCGGCGGAGGG
ACCAGGCTGACCGTCCTA

H-Variable (AA):

(SEQ ID NO: 398)
EVQLLESGGGLVQPGGSLRLSCAASGFTFSSYNNFWVRQAPGKGLEWVSR
IYPSGGWTYYADSVKGRFTISRDNSKNTLYLQNNSLRAEDTAVYYCARVT
VPLDSGSYYFDYWGQGTLVTVSS

H-Variable (DNA):

(SEQ ID NO: 399)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACATGA
TGTTTTGGGTTCGCCAAGCTCCTGGTAAAGGTTTGGAGTGGGTTTCTCGT
ATCTATCCTTCTGGTGGCTGGACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGTTACG
GTACCCCTTGATAGTGGGAGCTACTACTTTGACTACTGCGGCCAGGGAAC
CCTGGTCACCGTCTCAAGC

60. 806C-M0053-F06
L-Variable (AA):

(SEQ ID NO: 400)
QDIQMTQSPDTLSLSPGERATLSCRASHSVTNNRLAWYQQKPGQSPRLLI
YGASNRAAGIPARFSGSGSGTDFTLTISSLEPEDFAVYYCQQRSHWLYTF
GQGTKLEIK

L-Variable (DNA):

(SEQ ID NO: 401)
CAAGACATCCAGATGACCCAGTCTCCAGACACCCTGTCTTTCTCTCCAGG
AGAAAGACCCACCCTCTCATGCCGCAGCCAGTCACAGTGTTACTAACAAC
GCTTAGCTGGTACCAGCAGAAACCTGGCCAGTCTCCCAGGCTCCTCATC
TATGGTGCATCCAACAGGGCCGCTGGCATCCCTGCCAGGTTCAGTGGCAG
TGGCTCTGGGACAGACTTCACTCTCACCATCAGCAGCCTAGAGCCTGAAG
ATTTTGCAGTTTATTACTGTCAACAGCGTAGCCACTCGCTTTACACTTTT
GGCCAGGGGACCAAGCTGGAGATCAAA

H-Variable (AA):

(SEQ ID NO: 402)
EVQLLESGGGLVQPGGSLRLSCAASGFTFSSYIMIWVRQAPGKGLEWVSS
IYPSGGQTYYADSVKGRFTISRDNSKNTLYLQMNSLRAEDMAVYYCARKN
GYNNVFDVWGQGTMVTVSS

H-Variable (DNA):

(SEQ ID NO: 403)
GAAGTTCAATTGTTAGAGTCTGGTGGCGGTCTTGTTCAGCCTGGTGGTTC
TTTACGTCTTTCTTGCGCCTGCTTCCGGATTCACTTTCTCTTCTTACATTA
TGATTTGGGTTCGCCAAGCTCCTGGTAAAGGTTTGGAGTGGGTTTCTTCT
ATCTATCCTTCTGGTGGCCAGACTTATTATGCTGACTCCGTTAAAGGTCG
CTTCACTATCTCTAGAGACAACTCTAAGAATACTCTCTACTTGCAGATGA
ACAGCTTAAGGGCTCAGGACATGGCTGTGTATTACTGTCAAGAAAAAAT
GGCTACAATAATGTATTTGATGTCTGGGGCCAAGGGACAATGGTCACCGT
CTCAAGC

61. 806C-M0053-F08
L-Variable (AA):

(SEQ ID NO: 404)
QSALTQPASVSGSPGQSITTSCTCTSSDVGSYNLVSWYQQHPGKAPKLNI
YEGSKRPSGVSNRFSGSKSGNTASLTISGLQAEDEADYYCCSYAGSSTYV
FGTGTKVTVL

L-Variable (DNA):

(SEQ ID NO: 405)
CAGAGCGCTTTGACTCAGCCTCCCTCCGTGTCTGGGTCTCCTGGACAGTC
GATCACCATCTCCTGCACTGGAACCAGCAGTGATGTTGGGAGTTATAACC
TTGTCTCCTGGTACCAACAGCACCCAGGCAAAGCCCCCAAACTCATGATT
TATGAGGGCAGTACCGGCCCTCAGGGGTTTCTAATCCCTTCTCTGGCTCC
AAGTCTGGCAACACGGCCTCCCTGACAATCTCTGGGCTCCAGGCTCAGGA
CGAGGCTGATTATTACTGCTGCTCATATGCAGGTACTAGCACTTATGTCT
TCGGAACTGGGACCAAGGTCACCGTCCTA

H-Variable (AA):

(SEQ ID NO: 406)
EVQLLESGGGLVQPGGSLRLSCAASGFTFSRYPMLWVRQAPGKCLEWVSS
IYPSGCWTSYADSVKGRFTISRDNSKNTLYLQMNSLRAEDTAVYYCTTPT
HNWNDDPDAFDIWGQGTTXVTVSS

H-Variable (DNA):

(SEQ ID NO: 407)
GAAGTTCAATTGTTAGAGTCTGGTGGCGGTCTTGTTCAGCCTGGTGGTTC
TTTACGTCTTTCTTGCGCTGCTTCCGGATTCACTTTCTCGTTACCCTA
TGCTTTGGGTTCGCCAAGCTCCTGGTTGGTTTGGAGTGGGTTTCTTCTAT
CTATCCTTCTCGTGGCTGGACTTCTTATGCTGACTCCGTTAAGGTCGCTT
CACTATCTCTAGAGACAACTCTAAGAATACTCTCTACTTGCAGATGAACA
GCTTAAGGGCTGAGGACACAGCCGTGTATTACTGTACCACCCCTACCCAC
AACTGGAACGATGACCCTGATGCTTTTGATATCTGGGGCCAAGGGACCAC
GGTCACCGTCTCAAGC

62. 806C-M0053-G04
L-Variable (AA):

(SEQ ID NO: 408)
QSVLTQPPSVSVAPGQTATITCGGNNIGTKSVHWYQQKPGQAPVFVYDDN
DRPSGIPERFSGSNSGNTATMTISRVEAGDEADYYCQVWDPTGDQYVFGS
GTKVTVL

L-Variable (DNA):

(SEQ ID NO: 409)
CAGAGCGTCTTGACTCAGCCACCCTCGGTGTCAGTGGCCCCAGGACAGAC
GGCCACGATTACCTGTGGGGGAAACAACATTGGAACTAAAAGTGTACACT
GGTACCAGCAGAAGCCAGGCCAGGCCCCTGTCTTCGTCTATGATGATAAT
GACCGGCCCTCAGGGATCCCTGAGCGATTCTCTGGCTCCAACTCCGGCAA
CACGGCCACCATCACCATCAGCAGGGTCGAAGCCGGGGATGAGGCCGACT
ATTATTGTCAGGTGTGGGATCCTACTGGTGATCAGTATGTCTTCGGAAGT
GGGACCAAGGTCACCGTCCTA

H-Variable (AA):

(SEQ ID NO: 410)
EVQLLESGGGLVQPGGSLRLSCAASGFTFSKYKMLWVRQAPCKGLEWVSV
IYPSGGYTYYAJJSVKGRFTISRDNSKNTLYLQMNSLRAEDTAVYYCARV
VVPAFYYYYNLDVWGKGTTVTVSS

H-Variable (DNA):

(SEQ ID NO: 411)
GAAGTTCAATTGTTAGAGTCTGGTGGCGGTCTTGTTCAGCCTGGTGGTTC
TTTACGTCTTTCTTGCGCTGCTTCCGGATTCACTTTCTCTAAGTACAAGA
TGCTTTGGGTTCGCCAAGCTCCTGGTAAGGTTTGGAGTGGGTTTCTGTTA
TCTATCCTTCTGGTGGCTATACTTACTATGCTGACTCCGTTAAAGGTCCC
TTCACTATCTCTAGAGACAACTCTAAGAATACTCTCTACTTGCAGATGAA
CAGCTTAAGGGCTGAGGACACGGCCGTGTATTACTGTGCGAGAGTAGTAG
TACCAGCTTTCTACTACTACTACTACATGGACGTCTGGGGCAAAGCCACC
ACGGTCACCGTCTCAAGC

63. 806C-M0053-G05
L-Variable (AA):

(SEQ ID NO: 412)
QSELTQPASVSGSPGQSITISCTGTSSDVGGYNYVSWYQQHPGKAPKLMI
YEVSNRPSGVSNRFSGSKSGNTASLTISGLQAEDEADYYCSSYTSSSTLG
GVFGGGTKLTVL

L-Variable (DNA):

(SEQ ID NO: 413)
CAGAGCGAATTGACTCAGCCTGCCTCCGTGTCTGGGTCTCCTGGAAAGTC
GATCACCATCTCCTGCACTGGAACCAGCAGTGACGTTGGTGGTTATAACT
ATGTCTCCTGGTACCAACAGCACCCAGGCAAAGCCCCCAAACTCATGATT
TATGAGGTCAGTAATCGGCCCTCAGGGGTTTCTAATCGCTTCTCTGGCTC
CAAGTCTGGCAACACGGCCTCCCTGACCATCTCTGGGCTCCAGGCTGAGG
ACGAGGCTGATTATTACTGCAGCTCATATACAAGCAGCAGCACTCTCGGG
GGGTATTCGGCGGAGGGACCAAGCTGACCGTCCTA

-continued

H-Variable (AA):
(SEQ ID NO: 414)
EVQLLESGGGLVQPGGSLRLSCAASGFTFSKYKIVIDWVRQAPGKGLEWV
SSIYPSGGFTYYADSVKCRFTISRDNSKNTLYLQMNSLRAEDTAVYYCAR
EKMATMDYWGQGTLVTVSS H-Variable (DNA):
(SEQ ID NO: 415)
GAAGTTCAATTGTTAGAGTCTGGTGGCGGTCTTGTTCAGCCTGGTGGTTC
TTTACGTCTTTCTTGCGCTGCTTCCGGATTCACTTTCTCTAAGTACAAGA
TGGATTGGGTTCGCCAAGCTCCTGGTAAAGGTTTGGAGTGGGTTTCTTCT
ATCTATCCTTCTGGTGGCTTTACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGCCGTGTATTACTGTGCAAGAGAGAAG
ATGGCTACAATGCACTACTGGGGCCAGGGCACCCTGGTCACCGTCTCAAG
C 64. 806C-M0054-A08
L-Variable (AA):
(SEQ ID NO: 416)
QYELTQPASVSGSPGQSITISCTGTSSDVGGCNYVSWYQQHPGKAPQLLI
YDVSYRPSGVSNRFSGSKSGNTASLTISGLQADDEADYYCSSCTSSSTLF
GTGTKVTVL L-Variable (DNA):
(SEQ ID NO: 417)
CAGTACCAATTGACTCAACCTGCCTCCGTGTCTGGGTCTCCTGGACAGTC
GATCACCATCTCCTGCACTGGAACCAGCACTGACGTTGGTGGTTGTAACT
ATGTCTCCTGGTACCAACAACACCCAGGCAAAGCCCCCCAACTCTTGATT
TATGATGTCAGTTATCGGCCCTCAGGGGTTTCTAATCGCTTCTCTGGCTC
CAAGTCTGGCAACACGGCCTCCCTGACCATCTCTGGGCTCCAGGCTGACG
ACGAGGCTGATTACTACTGCAGCTCATGTACAAGTAGCAGCACTCTCTTC
GGAACTGGGACCAAGGTCACCGTCCTA H-Variable (AA):
(SEQ ID NO: 418)
EVQLLESGGGLVQPGGSLRLSCAASGFTFSRYVMHWVRQAPGKGLEWVSR
IYPSGGWTYYADSVKGRFTISRDNSKNTLYLQNKSLRAEDTAVYYCARVA
GESNGMDVWGQGTTVTVSS H-Variable (DNA):
(SEQ ID NO: 419)
GAAGTTCAATTGTTAGAGTCTGGTCGCGGTCTTGTTCAGCCTCGTGGTTC
TTTACGTCTTTCTTGCGCTGCTTCCGGATTCACTTTCTCTCGTTACGTTA
TGCATTGGGTTCGCCAAGCTCCTGGTAAAGGTTTGGAGTGGGTTTCTCGT
ATCTATCCTTCTGGTGGCTGGACTTATTATGCTGACTCCGTTAAAGGTCG
CTTCACTATCTCTAGAGACAACTCTAAGAATACTCTCTACTTGCAGATGA
ACAGCTTAAGGGCTGACGACACGCCCGTCTATTACTGTGCGAGAGTGGCT
GGGGAGTCGAACGGTATGGACGTCTGGCGCCAAGGGACCACGGTCACCGT
CTCAAGC 65. 806C-M0054-B06
L-Variable (AA):
(SEQ ID NO: 420)
QDIQMTQSPSSLSASIGDRVTVTCRTSQSIDTYLNNYQQKPGQAPNLLIY
GASSLESCVPSRFSGSGSGTDFTLTISSLQPEDFATYYCQQSYTTSYTFG
RCTTLEIQ L-Variable (DNA):
(SEQ ID NO: 421)
CAAGACATCCAGATGACCCAGTCTCCATCCTCCCTGTCAGCATCTATAGG
AGACAGAGTCACCGTCACTTGCCGCACAAGTCAGAGCATTGACACCTATT
TAAATTGGTATCAGCAAAAACCAGGGCAAGCCCCTAACCTCCTGATCTAT
GGTGCATCCAGTTTGGAAAGTGGGGTCCCATCAAGGTTCAGTGGCAGTGG
ATCTGGGACAGATTTCACTCTCACCATCAGCAGTCTGCAACCTGAAGATT
TTGCAACTTACTACTGTCAACAGAGTTACACTACCTCCTACACTTTTGGC
CGGGGGACCACGCTGGAGATCCAA H-Variable (AA):
(SEQ ID NO: 422)
EVQLLESGCCLVQPGGSLRLSCAASGFTFSIYKMQWVRQAPGKGLEWVSS
IYPSGGATYYADSVKGRETISRDNSKNTLYLQMNSLRAEDTAVYYCARQT
YYYDSSGYFRNAFDIWGQGTNVTVSS H-Variable (DNA):
(SEQ ID NO: 423)
GAAGTTCAATTGTTAGAGTCTGGTGGCGGTCTTCTTCAGCCTGGTGGTTC
TTTACGTCTTTCTTGCGCTGCTTCCGGATTCACTTTCTCTATTTACAAGA
TGCAGTGGGTTCGCCAAGCTCCTGGTAAAGGTTTGGAGTGGGTTTCTTCT
ATCTATCCTTCTGGTGGCGCTACTTATTATGCTGACTCCGTTAAAGGTCG -continued CTTCACTATCTCTAGAGACAACTCTAAGAATACTCTCTACTTGCAGATGA
ACAGCTTAAGGGCTGAGGACACGCCGTGTATTACTGTGCGAGACAAACG
TATTACTATGATAGTAGTGGTTATTTCCGCAATGCTTTTGATATCTGGGG
CCAAGGGACAATGGTCACCGTCTCAAGC 66. 806C-M0054-B08
L-Variable (AA):
(SEQ ID NO: 424)
QSVLTQAASVSGSPGQSITLSCTGATRDVSWYQQHPGKAPKLVLYEVNSR
PSDVSDRFSGSMSGNTASLTISGLQAEDEADYYCSSTTSRAPRVIFGGGT
KLTVL L-Variable (DNA):
(SEQ ID NO: 425)
CAGAGCGTCTTGACTCAGGCTGCCTCCGTGTCTGGGTCTCCTGGACAGTC
GATCACCCTCTCCTCCACTGGAGCCACCAGGGACGTCTCCTGGTACCAAC
AACACCCAGGCAAAGCCCCCAAACTCGTCCTTTATGAAGTCAATAGTCGC
CCCTCAGACGTTTCCGATCGCTTCTCTGGCTCCATGTCTGGCAACACGGC
CTCCCTGACCATCTCTGGACTCCAGGCTGAAGACGAGGCTGATTATTACT
GCTCCTCAACCACAAGTCGCGCCCCTCGCGTGATTTTCGGCGGAGGGACC
AAACTGACCGTCCTA H-Variable (AA):
(SEQ ID NO: 426)
EVQLLESGGGLVQPGGSLRLSCAASGFTFSRYRMVWVRQAPGKGLEWVSW
IYPSGGWTSYADSVKGRFTISRDNSKNTLYLQMNSLRAEDTAVYYCARSN
YYDSAATLDIWGQGTMVTVSS H-Variable (DNA):
(SEQ ID NO: 427)
GAAGTTCAATTGTTAGAGTCTGGTGGCCGTCTTGTTCAGCCTGGTGGTTC
TTTACGTCTTTCTTGCGCTGCTTCCGGATTCACTTTCTCTCGTTACCGTA
TGGTTTGGGTTCGCCAAGCTCCTGGTAAAGGTTTGGAGTGGGTTTCTTGG
ATCTATCCTTCTGGTGGCTGGACTTCTTATGCTGACTCCGTTAAAGGTCG
CTTCACTATCTCTAGAGACAACTCTAAGAATACTCTCTACTTGCAGATGA
ACAGCTTAAGGGCTGAGGACACGCCGTGTATTACTGTGCGAGGTCAAAT
TACTATGATAGTGCTGCGACTCTTGATATCTGGGGCCAAGGGACAATGGT
CACCGTCTCAAGC 67. 806C-M0054-C03
L-Variable (AA):
(SEQ ID NO: 428)
QDIQMTQSPSSLSASVGDRVTITCRASQTISSYLNWYQQKPGKAPKLLIS
AASTLQSGVPSRFSGSGSGTDFTLTISSLQPEDFATYYCQQSYSTPSFGQ
GTKVEIK L-Variable (DNA):
(SEQ ID NO: 429)
CAAGACATCCAGATGACCCAGTCTCCATCCTCCCTGTCTGCATCTGTAGG
AGACAGAGTCACCATCACTTGCCGGCAAGTCAGACCATTAGCAGCTATT
TAAATTGGTATCAGCAGAAACCAGGGAAAGCCCCTAAGCTCCTGATCTCT
GCTGCATCCACTTTGCAAAGTGGGGTCCCATCAAGGTTCAGTGGCAGTGG
ATCTGGGACAGATTTCACTCTCACCATCAGCAGTCTGCAACCTGAAGATT
TTGCAACTTACTACTGTCAACAGAGTTACAGTACCCCCTCGTTCGGCCAA
GGGACCAAGGTGCAAATCAAA H-Variable (AA):
(SEQ ID NO: 430)
EVQLLESGGGLVQPGGSLRLSCAASGFTFSRYQMLWVRQAPGKGLEWVSS
IYPSGGWTYYADSVKGRFTISRDNSKNTLYLQMNSLRAEDTAVYYCARVG
YSSGWYALTSKTFDYWGQGTLVTVSS H-Variable (DNA):
(SEQ ID NO: 431)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCATTACCAGA
TGCTTTGGGTTCGCCAAGCTCCTGGTAAAGGTTTGGAGTGGGTTTCTTCT
ATCTATCCTTCTGGTGGCTGGACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGCCGTGTATTACTCTGCGAGAGTGGGG
TATAGCAGTGGCTGGTACGCGTTGACTTCAAAAGACTTTTGACTACTGGG
GCCAGGGAACCCTGGTCACCGTCTCAAGC 68. 806C-M0054-C07
L-Variable (AA):
(SEQ ID NO: 432)
QDIQMTQSPATLSLSPGDRAILSCRASHNIDNFLAWYQQKPGQAPRLLIY
DASHPATGIPPRFSCSGSGTDFTLTISSLEPEDFAVYFCQQRTNWLFGCG
TKVEIK L-Variable (DNA):
(SEQ ID NO: 433)
CAAGACATCCAGATGACCCAGTCTCCAGCCACCCTGTCTTTGTCTCCGGG
GGATCGAGCCATCCTCTCCTGTAGGGCCAGTCACAATATTGACAACTTCT
TAGCCTGGTATCAACAGAACCTGCCCAGGCTCCCAGGCTCCTCATCTATG
ATGCATCTCATACGGCCACTGGCATCCCCCCCGGTTCAGTGGCAGTGGG
TCTGGGACAGACTTCACTCTCACCATCAGCAGCCTAGAACCTGAAGATTT
TGCTGTGTATTTCTGTCAACAACGGACCAACTGGCTTTTCGGCGCAGGGA
CCAAGGTGGACATCAAA H-Variable (AA):
(SEQ ID NO: 434)
EVQLLESGGGLVQPGGSLRLSCAASGFTFSRYPNWVRQAPGKGLEWVSRI
WPSGGSTVYADSVKGRFTISRDNSKNTLYLQMNSLRAEDTAVYYCARDSS
RYFDVWCRGTLVTVSS H-Variable (DNA):
(SEQ ID NO: 435)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACCCTA
TGAATTGGGTTCGCCAAGCTCCTGGTAAAGGTTTGGAGTGGGTTTCTCGT
ATCTGGCCTTCTGGTGGCTCTACTGTTTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGATTCT
TCTCGATACTTCGATGTCTGGGGCCGTGGCACCCTGGTCACCGTCTCAAG
C 69. 806C-M0054-E04
L-Variable (AA):
(SEQ ID NO: 436)
QDIQMTQSPATLSVSPGERATLSCRASQSISSNLAWYQQKPGQAPRLLIY
GTSTRATGIPARFSGSGSGTEFTLTISSLQSEDFVVYYCQQYKDWPLTFG
GGTTVEIK L-Variable (DNA):
(SEQ ID NO: 437)
CAAGACATCCACATGACCCAGTCTCCAGCCACCCTGTCTGTGTCTCCAGG
GGAAAGAGCCACCCTCTCCTGCAGGGCCAGTCAGAGTATTAGCAGTAATT
TAGCCTGGTACCAACAAAAACCTGGCCAGGCTCCCAGGCTCCTCATCTAT
GGTACATCCACCAGGGCCACTGGTATCCCAGCCAGGTTCAGTGGCAGTGG
GTCTGGGACCGAGTTCACTCTCACCATCAGCAGCCTGCAGTCTGAAGATT
TTGTAGTTTATTACTGTCAGCAGTATAAAGACTGGCCTCTCACTTTCGGC
GGAGGGACCACGGTGGAGATCAAG H-Variable (AA):
(SEQ ID NO: 438)
EVQLLESGGGLVQPGGSLRLSCAASGFTFSNYKNHWVRQAPGKGLEWVSV
IYPSGGVTEYANSVKGRFTISRDNSKNTLYLQNNSLRAEDTAVYYCARDQ
YSGHDYWGQGTLVTVSS H-Variable (DNA):
(SEQ ID NO: 439)
GAAGTTCAATTGTTAGAGTCTGGTGGCGGTCTTGTTCAGCCTGGTGGTTC
TTTACGTCTTTCTTGCGCTGCTTCCGGATTCACTTTCTCTAATTACAAGA
TGCATTGGGTTCGCCAAGCTCCTGGTAAAGGTTTGGAGTGGGTTTCTGTT
ATCTATCCTTCTGGTGGCGTTACTGAGTATGCTGACTCCGTTAAAGGTCG
CTTCACTATCTCTAGAGACAACTCTAAGAATACTCTCTACTTCCAGATGA
ACAGCTTAAGGGCTGAGCACACGGCCGTGTATTACTGTGCGAGAGATCAA
TACAGTGGCCATGACTACTGGGGCCAGGGAACCCTGGTCACCGTCTCAAG
C 70. 806C-M0054-G01
L-Variable (AA):
(SEQ ID NO: 440)
QDIQMTQSPGTLSLSPCERATLSCRASQSVSSYLAWYQQKPGQAPRLLIY
DASNRATGIPARFSGSGSGTDFTLTISSLEPEDFAVYYCQQRYSWPLTFG
GGTKVEIK L-Variable (DNA):
(SEQ ID NO: 441)
CAAGACATCCAGATGACCCAGTCTCCAGGCACCCTGTCTTTGTCTCCAGG
GGAAAGAGCCACCCTCTCCTGCAGGGCCAGTCAGAGTGTTAGCAGCTACT
TAGCCTGGTACCAACAGAAACCTGGCCAGGCTCCCAGGCTCCTCATCTAT
GATCCATCCAACAGGGCCACTGGCATCCCAGCCAGGTTCAGTGGCAGTGG
GTCTGGGACAGACTTCACTCTCACCATCAGCAGCCTAGAGCCTGAAGATT
TTGCAGTTTATTACTGTCAGCAGCGTTACAGCTGGCCTCTCACTTTCGGC
GGAGGGACCAACGTGGAGATCAAG H-Variable (AA):
(SEQ ID NO: 442)
EVQLLESGGGLVQPGGSLRLSCAASGFTFSEYQMIWVRQAPGKGLEWVSY
TVPSGGFTAYADSVKGRFTISRDNSKNTLYLQMNSLRAEDTAVYYCARVN
YYGMDVWGQGTTVTVSS H-Variable (DNA):
(SEQ ID NO: 443)
GAAGTTCAATTGTTAGAGTCTGGTGGCGGTCTTGTTCAGCCTGGTGGTTC
TTTACGTCTTTCTTGCGCTGCTTCCGGATTCACTTTCTCTGAGTACCACA
TCATTTGGGTTCGCCAAGCTCCTGGTAAAGGTTTGGAGTGGGTTTCTTAT
ATCGTTCCTTCTGGTGGCTTTACTGCTTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGTGAAC
TACTACGGTATGGACGTCTGGGGCCAAGGGACCACGGTCACCGTCTCAAG
C 71. 806C-M0054-G05
L-Variable (AA):
(SEQ ID NO: 444)
QSALTQPASVSGSPGQSISISCTGTNTDVGGYNYVSWYQQHPGKAPKLMY
DVSNRPSGVSNRFSGSKSGNTASLTISGLQAEDEADYYCSSYTSSSTWVF
GGGTKLTVL L-Variable (DNA):
(SEQ ID NO: 445)
CAGAGCGCTTTGACTCAGCCTGCCTCCGTGTCTGGGTCTCCTGCACAGTC
GATCAGCATCTCCTGCACTGGAACCAACACTGACGTTGGTGGTTATAACT
ATGTCTCCTGGTACCAACAACACCCAGGCAAAGCCCCCAAACTCATGATT
TATGATGTCAGTAATCGGCCCTCAGGGGTTTCTAATCGCTTCTCTGGCTC
CAAGTCTGGCAACACGGCCTCCCTGACCATCTCTGGGCTCCAGGCTGAGG
ACGAGGCTGATTATTACTGCAGCTCATATACAAGTACTAGCACTTGCGTG
TTCGGCGGAGGGACCAAGCTGACCGTCCTA H-Variable (AA):
(SEQ ID NO: 446)
EVQLLESGCGLVQPGGSLRLSCAASGFTFSAYLMEWVRQAPGKGLEWVSG
IYPSGGKTYYSXZKGRFTISRDNSKNTLYLQMNSLRAEDTAVYYCARVNV
ISVAGTGYYYCMDVWGQGTTVTVSS H-Variable (DNA):
(SEQ ID NO: 447)
GAAGTTCAATTGTTAGAGTCTGGTGGCGGTCTTGTTCAGCCTGGTGGTTC
TTTACGTCTTTCTTGCGCTGCTTCCGGATTCACTTTCTCCTTACCCTTA
TGGAGTGGGTTCGCCAAGCTCCTGCTAAAGGTTTGGAGTGGGTTTCTGGT
ATCTATCCTTCTGGTGGCAAGACTTATTATGCTGACTCCGTTAAAGGTCG
CTTCACTATCTCTAGAGACAACTCTAAGAATACTCTCTACTTGCAGATGA
ACAGCTTAAGGGCTGACGACACGGCCGTGTATTACTGTGCGAGAGTGAAC
GTTATATCAGTGGCTGGTACTGGCTACTACTACTACGGTATGGACGTCTG
GGGCCAAGGGACCACGGTCACCGTCTCAAGC 72. 806C-M0054-H10
L-Variable (AA):
(SEQ ID NO: 448)
QDIQMTQSPATLSLSPGERATLSCRASQSVSIYLAWYQQKPGQAPRLLIY
DASNRATDIPARFSGSGSGTDFTLTISSLEPEDFAVYYCQQRSSWPITFG
LGTRLEIK L-Variable (DNA):
(SEQ ID NO: 449)
CAAGACATCCAGATGACCCAGTCTCCAGCCACCCTGTCTTTGTCTCCAGG
GGAAAGAGCCACCCTCTCCTGCAGGGCCAGTCAGAGTGTTAGCATCTACT
TAGCCTGGTACCAACAGAAACCTGGCCAGGCTCCCAGGCTCCTCATCTAT
GATGCATCCAACAGGGCCACTGACATCCCAGCCAGGTTCAGTGGCAGTGG
GTCTGGGACAGACTTCACTCTCACCATCAGCAGCCTAGAGCCTGAAGATT
TTGCAGTTTATTACTGTCAGCAACGTAGCAGCTGGCCGATCACCTTCGGC
CTTGGGACACGACTGGAGATTAAA H-Variable (AA):
(SEQ ID NO: 450)
EVQLLESGGGLVQPGGSLRLSCAASGFTFSQYPMWVRQAPGKGLEWVSV
ISPSGGHTSYADSVKGRFTISRDNSKNTLYLQNNSLRAEDTAVYYCARIQ
YYGGAFDIWGQGKNVTVSS H-Variable (DNA):
(SEQ ID NO: 451)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCAGTACCCTA
TGATTTGGGTTCGCCAAGCTCCTGGTAAAGGTTTGGAGTGGGTTTCTGTT
ATCTCTCCTTCTGGTGGCCATACTTCTTATGCTGACTCCGTTAAAGGTCG

73. 806C-M0055-A09
L-Variable (AA):

(SEQ ID NO: 452)
QDIQMTQSPSSLSASVGDGVTITCRASQSINNHLNWYQQKPGKAPKVLIY
AASSLQSGVPSRFSGSGSCTDFTLTTSSLQPEDFATYYCQQSYSTPWTFG
QGTKVEIK

L-Variable (DNA):

(SEQ ID NO: 453)
CAAGACATCCAGATGACCCAGTCTCCATCCTCCCTGTCTGCATCTGTAGG
AGACGGAGTCACCATCACTTGCCGGGCAAGTCAGAGCATTAACAACCATT
TAAATTGGTATCAGCAGAAACCAGGGAAAGCCCCTAAGGTCCTGATCTAT
GCTGCATCCAGTTTGCAAAGTGGGGTCCCATCAAGGTTCAGTGGCAGTGG
ATCTGGGACAGATTTCACTCTCACCATCAGCAGTCTGCAACCTGAAGATT
TTGCAACTTACTACTGTCAACAGAGTTACAGTACCCCGTGGACGTTCGGC
CAAGGGACCAAGGTGGAAAATCAAA

H-Variable (AA):

(SEQ ID NO: 454)
EVQLLESGGGLVQPGGSLRLSCAASGFTFSKYRMSWVRQAPKGLEWVSC
IYPSGGGTTYADSVKGRFTISRDNSKNTLYLQMNSLRAEDTAVYYCARPT
YYYDSSGYYYSGPIDYWGQGTLVTVSS

H-Variable (DNA):

(SEQ ID NO: 455)
CAAGTTCAATTGTTAGAGTCTGGTGGCGGTCTTGTTCAGCCTGGTGGTTC
TTTACGTCTTTCTTGCGCTGCTTCCGGATTCACTTTCTCTAAGTACCGTA
TGTCTTGGGTTCGCCAAGCTCCTGGTAAAGGTTTGGAGTGGGTTTCTGGT
ATCTATCCTTCTGGTGGTGGTACTACTTATGCTGACTCCGTTAAAGGGTC
CCTTCACTATCTCTAGAGACAACTCTAAGAATACTCTCTACTTGCAGATG
AACAGCTTAAGGGCTGAGCACACGGCCCTGTATTACTGTGCGAGACCCAC
GTATTACTATGATAGTAGTGGTTATTACTACTCGGGGCCTATTGACTACT
GGGGCCAGGGAACCCTGGTCACCGTCTCAAGC

74. 806C-M0055-B11
L-Variable (AA):

(SEQ ID NO: 456)
QYELTQPASVSGSPGQSITISCTGTNTDVGGYNLVSWYQQHPGKAPKLII
YEVSNRPSGVSNRFSGSKSGNTASLTISGLQAEDEVDYYCGSYTSSSTHV
FGSGTKVTVL

L-Variable (DNA):

(SEQ ID NO: 457)
CAGTACGAATTGACTCAGCCTGCCTCCGTGTCTGGGTCTCCTGGACAGTC
GATCACCATCTCCTGCACTGGAACCAACACTGACCTTGGTGGTTATAACC
TTGTCTCCTGGTACCAACAGCACCCAGGCAAAGCCCCCAAACTCATAATT
TATGAGGTCAGTAATCGGCCCTCAGGGGTTTCTAATCGCTTCTCTGGCTC
CAAGTCTGGCAACACGGCCTCCCTGACCATCTCTGGGCTCCAGGCTGAGG
ACGAGGTTGATTATTATTGCGGCTCATATACAAGCAGCAGTACTCATGTC
TTCGGAAGTGGGACCAAGGTCACCGTCCTA

H-Variable (AA):

(SEQ ID NO: 458)
EVQLLESGGGLVQPGGSLRLSCAASGFTFSAYKMHWVRQAPKGLEWVSV
IYPSGGWTYYADSVKGRFTISRDNSKNTLYLQMNSLRAEDTAVYYCARGT
AGWFDPWGQGTLVTVSS

H-Variable (DNA):

(SEQ ID NO: 459)
GAAGTTCAATTGTTAGAGTCTGGTGGCGGTCTTGTTCAGCCTGGTGGTTC
TTTACGTCTTTCTTGCGCTGCTTCCGGATTCACTTTCTCTGCTTACAAGA
TGCATTGGGTTCGCCAAGCTCCTGGTAAAGGTTTGGAGTGGGTTTCTGTT
ATCTATCCTTCTGGTGGCTGGACTTATTATGCTGACTCCGTTAAGGTCGC
TTCACTATCTCTAGAGACAACTCTAAGAATACTCTCTACTTGCAGATGAA
CAGCTTAAGGGCTGAGGACACGGCCGTGTATTACTGTGCAAGAGGGACTG
CAGGGTGGTTCCACCCTTGGGGCCAGGGAACCCTGGTCACCGTCTCAAGC

75. 806C-M0055-B12
L-Variable (AA):

(SEQ ID NO: 460)
QSELTQPASVSCSPGQSITISCTGTSSDVGSYNLVSWYQQHPGKAPKLMI
YEGSKRPSGVSNRFSGSKSGNTASLTISGLQAEDEADYYCCSYAGSSTYV
FGTGTKVTVL

L-Variable (DNA):

(SEQ ID NO: 461)
CAGAGCGAATTGACTCAGCCTGCCTCCGTGTCTGGGTCTCCTGGACAGTC
GATCACCATCTCCTGCACTGGAACCAGCAGTGATGTTGGGAGTTATAACC
TTGTCTCCTGGTACCAACAGCACCCAGGCAAAGCCCCCAAACTCATGATT
TATGAGGGCAGTAAGCGGCCCTCAGGGGTTTCTAATCGCTTCTCTGGCTC
CAAGTCTGGCAACACGGCCTCCCTGACAATCTCTGGGCTCCAGGCTGAGG
ACGAGGCTGATTATTACTGCTGCTCATATGCAGGTAGTAGCACTTATGTC
TTCGGAACTGGGACCAAGGTCACCGTCCTA

H-Variable (AA):

(SEQ ID NO: 462)
EVQLLESGGGLVQPGGSLRLSCAASGFTFSNYKMTWXTRQAPCKGLEWVS
SIYPSGGWTYYADSVKGRFTISRDNSKNTLYLQMNSLRAEDTAMYYCARQ
EDGGYGTWGQGTLVTVSS

H-Variable (DNA):

(SEQ ID NO: 463)
GAAGTTCAATTGTTAGAGTCTGGTGGCGGTCTTGTTCAGCCTGGTGGTTC
TTTACGTCTTTCTTGCGCTGCTTCCGGATTCACTTTCTCTAATTACAAGA
TGACTTGGGCTTCGCCAAGCTCCTGGTAAAGGTTTGGAGTGGGTTTCTTCT
ATCTATCCTTCTGGTGGCTGGACTTATTATGCTGACTCCGTTAAAGGTCG
CTTCACTATCTCTAGAGACAACTCTAAGAATACTCTCTACTTGCAGATGA
ACAGCTTAAGGGCTGAGGACACCGCCATGTATTACTGTGCGAGACAGGAG
GATGGTGGCTACGGGACTTGGGGCCAGGGAACCCTGGTCACCGTCTCAAG
C

76. 806C-M0055-C05
L-Variable (AA):

(SEQ ID NO: 464)
QSVLTQDPAVSVALGQTVRITCQGDSLRSYYATWYQQKPGQAPVLVIYGE
NNRPSGIPDRFSGSSSGNTGSLTITGAQAEDEADYYCNSRDTSGSHLLFG
GGTKLTVL

L-Variable (DNA):

(SEQ ID NO: 465)
CAGAGCGTCTTGACTCAGGACCCTGCTGTGTCTGTGGCCTTGGGACAGAC
AGTCAGGATCACATGCCAAGGAGACAGCCTCAGAAGCTATTATGCAACCT
GGTACCAACAGAAGCCAGGACAGGCCCCTGTACTTGTCATCTATGGTGAA
AACAACCGGCCCTCAGGGATCCCAGACCGATTCTCTGGCTCCAGCTCAGC
AAACACAGGTTCCTTGACCATCACTGGCCCTCAGGCGGAAGATGAGGCTG
ACTATTACTGTAACTCCCGGGACACCAGTGGTAGTCATCTATTATTCGGC
GGAGGGACCAAGCTGACCGTCCTG

H-Variable (AA):

(SEQ ID NO: 466)
EVQLLESGGGLVQPGGSLRLSCAASGFTFSQYKNLWVRQAPGKGLEWVSS
IYPSGGWTSYADSVKGRFTISRDNSKNTLYLQMNSLRAEDTAVYYCARAS
YYDSGGYYRENFQFWGQGTLVTVSS

H-Variable (DNA):

(SEQ ID NO: 467)
GAAGTTCAATTGTTAGAGTCTGGTGGCGGTCTTGTTCACCCTGCTGGTTC
TTTACGTCTTTCTTGCGCTCCTTCCGGATTCACTTTCTCAGTACAAGA
TGCTTTGGGTTCGCCAAGCTCCTGGTAAAGGTTTGGAGTGGGTTTCTTCT
ATCTATCCTTCTGGTGGCTGGACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGCCTCT
TACTATGATAGTGGAGGTTATTACCGAGAAAACTTCCAGTTTTGGGGCCA
GGGCACCCTGGTCACCGTCTCAAGC

77. 806C-M0055-C07
L-Variable (AA):

(SEQ ID NO: 468)
QDIQMTQSPSSLSASVGDRVTIICRASQSISIYLNWYQQKPGKAPKVLIY
DASSLQSGVPSRFSGSGSGTDFSLTITSLQPEDFATYYCQQSYSTPPNYT
FGQGTKLEIK

L-Variable (DNA):

(SEQ ID NO: 469)
CAAGACATCCAGATGACCCAGTCTCCATCCTCCCTGTCTGCATCTGTAGG
AGACAGAGTCACCATCATTTGCCGGGCAAGTCAGAGCATCAGCATCTATT
TAAATTGGTATCAGCAGAAACCAGGGAAAGCCCCTAAGGTCCTGATATAT
GATGCATCCAGTTTGCAAAGTGGGGTCCCATCAAGGTTCAGTGGCAGTGG
ATCTGGGACAGATTTCAGTCTCACCATCACCAGTCTGCAACCTGAAGATT
TTGCAACTTACTACTGTCAACAGAGTTACAGTACCCCTCCCATGTACACT
TTTGGCCAGGGGACCAAGCTGGAGATCAAA

-continued

H-Variable (AA):
(SEQ ID NO: 470)
EVQLLESGGGLVQPGGSLRLSCAASGFTFSSYKMHWVRQAPGKGLEWVSV
IYPSGGATYYADSVKGRFTISRDNSKNTLYLQMNSLRAEDTATYYCAKGL
DFWSGPDYWGQGTLVTSS H-Variable (DNA):
(SEQ ID NO: 471)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACAAGA
TGCATTGGGTTCGCCAAGCTCCTGGTAAAGGTTTGGAGTGCGTTTCTGTT
ATCTATCCTTCTGGTGGCGCTACTTATTATGCTGACTCTCTTAAAGGTCG
CTTCACTATCTCTAGAGACAACTCTAAGAATACTCTCTACTTGCAGATGA
ACAGCTTAAGGGCTGAGGACACAGCCACATATTACTGTGCAAAAGGGCTC
GATTTTTGGAGTGGCCCGGACTACTGGGGCCAGGGCACCCTGGTCACCGT
CTCAAGC 78. 806C-M0055-D03
L-Variable (AA):
(SEQ ID NO: 472)
QDIQMTQSPSSLSASVGDRVTITCWASQDIRTSLAWYQQKPGKPPKLLIF
AASTLQGGVPSRFSGSGSGTEFTLTISGLQPEDFATYYCQHLNGYPLTFG
DGTKVEIR L-Variable (DNA):
(SEQ ID NO: 473)
CAAGACATCCAGATGACCCAGTCTCCATCCTCCCTGTCTGCATCTGTAGG
AGACAGAGTCACCATCACTTGCTGGGCCAGTCAGGATATTCGCACTTCTT
TAGCCTGGTATCAGCAGAAACCAGGGAAACCCCCTAAACTCCTCATCTTT
GCTGCGTCTACTTTGCAAGGTGGGGTCCCATCAAGGTTCAGCGGCAGTGG
ATCTGGGACAGAATTCACTCTCACAATCTCCGGCCTGCAGCCTGAGGATT
TTGCGACTTATTACTGTCAGCACCTTAATGGTTACCCGCTCACTTTCGGC
GATGGGACCAAGGTGGAGATCAGA H-Variable (AA):
(SEQ ID NO: 474)
EVQLLESGGGLVQPGGSLRLSCAASGFTFSNYVMQWVRQAPGKGLEWVSV
IYPSGGMTNYADSVKGRFTTSRDNSKNTLYLQMNSLRAEDTATYYCARIR
GDTRAFDIWGQGTMVTSS H-Variable (DNA):
(SEQ ID NO: 475)
GAAGTTCAATTGTTAGAGTCTGGTGGCGGTCTTGTTCAGCCTGGTGGTTC
TTTACGTCTTTCTTGCGCTGCTTCCGGATTCACTTTCTCTAATTACCTTA
TGCAGTGGGTTCGCCAAGCTCCTGGTAAAGGTTTGGAGTGGGTTTCTGTT
ATCTATCCTTCTGGTGGCATGACTAATTATGCTGACTCCGTTAAAGGTCG
CTTCACTATCTCTAGAGACAACTCTAAGAATACTCTCTACTTGCAGATGA
ACAGCTTAAGGGCTGAGGACACAGCCACGTATTACTGTGCACGGATACGC
GGTGACACCAGGGCTTTTGATATCTGGGGCCAAGGGACAATGGTCACCGT
CTCAAGC 79. 806C-M0055-D06
L-Variable (AA):
(SEQ ID NO: 476)
QDIQNTQSPGTLSLSPGERATLSCRASQSVSSSYLAWYQQKPGQAPRLLI
YCASSRATGIPDRFSGSGSGTDFTLTISRLEPEDLAVYYCQLFGSSPRIT
FGQGTRLEIK L-Variable (DNA):
(SEQ ID NO: 477)
CAAGACATCCAGATGACCCAGTCTCCAGGCACCCTGTCTTTGTCTCCAGG
GGAAAGAGCCACCCTCTCCTGCAGGGCCAGTCAGAGTGTTAGCAGCAGCT
ACTTAGCCTGGTACCAGCAGAAACCTGGCCAGGCTCCCAGGCTCCTCATC
TATGGTGCATCCAGCAGGGCCACTGGCATCCCAGACAGGTTCAGTGGCAG
TGGGTCTGGGACAGACTTCACTCTCACCATCAGCAGACTGGAGCCTGAAG
ATTTGGCAGTATATTACTGTCAGCTGTTTGGAAGCTCTCCTCGGATCACC
TTCGGCCAGGGGACGCGGCTGGAAATTAAA H-Variable (AA):
(SEQ ID NO: 478)
EVQLLESGGGLVQPGGSLRLSCAASGFTFSKYKMMWVRQAPGKGLEWVSV
IYPSGCATYYADSVKGRFTISRDNSKNTLYLQNNSLRAEDTAVYYCARSS
LGCSSTSCYDAFDIWGQGTMVTSS H-Variable (DNA):
(SEQ ID NO: 479)
GAAGTTCAATTGTTAGAGTCTGGTGGCGGTCTTGTTCAGCCTGGTGGTTC
TTTACGTCTTTCTTGCGCTGCTTCCGGATTCACTTTCTCTAAGTACAAGA
TGATGTGGGTTCGCCAAGCTCCTGGTAAAGGTTTGGAGTGGGTTTCTGTT
ATCTATCCTTCTGGTTGCGCTACTTATTATGCTGACTCCGTTAAAGGTCG -continued CTTCACTATCTCTAGAGACAACTCTAAGAATACTCTCTACTTGCAGATGA
ACAGCTTAAGGGCTGAGGACACGGCCGTGTATTACTGTGCGAGGTCTTCT
CTAGGGTGTAGTAGTACCAGCTGCTATGATGCTTTTGATATCTGGGGCCA
AGGGACAATGGTCACCGTCTCAAGC 80. 806C-M0055-D12
L-Variable (AA):
(SEQ ID NO: 480)
QDIQNTQSPSSLSASVGDRVTITCRASQGISNYLAWYQQKPGKVPKLLIY
AASTLQSGVPSRFSGSGSGTDFTLTISSLQPEDVATYYCQKYNSAPWTFG
QGTKVEIK L-Variable (DNA):
(SEQ ID NO: 481)
CAAGACATCCAGATGACCCAGTCTCCATCCTCCCTGTCTGCATCTGTAGG
AGACAGAGTCACCATCACTTGCCGGGCGAGTCAGGGCATTAOCAATTATT
TAGCCTGGTATCAGCAGAAACCAGGGAAGTTCCTAAGCTCCTGATCTATGC
TCCATCCACTTTGCAATCAGGGGTCCCATCTCGGTTCAGTGGCAGTGGAT
CTGGGACAGATTTCACTCTCACCATCAGCAGCCTGCAGCCTGAAGATGTT
GCAACTTATTACTGTCAGTATACAGTGCCCCCTGGACGTTCGGCCAAGGG
ACCAAGGTGGAAATCAAA H-Variable (AA):
(SEQ ID NO: 482)
EVQLLESGGGLVQPGGSLRLSCAASGFTFSTYGMWWVRQAPGKGLEWVSS
ISSGGSTAYADSVKGRETISRDNSKNTLYLQMNSLRAEDTAVYYCARDLT
TVTGNYFDYWGQGTAVVSS H-Variable (DNA):
(SEQ ID NO: 483)
GAAGTTCAATTCTTAGAGTCTGGTGGCGGTCTTGTTCAGCCTGGTGGTTC
TTTACGTCTTTCTTGCGCTGCTTCCGGATTCACTTTCTCTACTTACGGTA
TGTGGTGGGTTCGCCAGCTCCTGGTAGGTTTGGAGTGGGTTTCTTCTATC
TCTTCTGGTGGCTCTACTGTTTATGCTGACTCCGTTAAAGGTCGCTTCAC
TATCTCTAGAGACAACTCTAACAATACTCTCTACTTGCAGATCAACAGCT
TTGGGCTGAGGACACGGCCGTGTATTACTGTGCGAGAGATCTGACTACGG
TGACGGGGAACTACTTTGACTACTGGGGCCAGGGAACCCTGGTCACCGTC
TCAAGC 81. 806C-M0055-E04
L-Variable (AA):
(SEQ ID NO: 484)
QDIQMTQSPGTLSLSPGERATLSCRASQSVSSSQLAWYQHKRGQPPRLLI
YGASSRATGIPDRFSGSGSGTDYILTISRLEPEDFAVYYCQHFGSSPPAT
FGQGTKVEIK L-Variable (DNA):
(SEQ ID NO: 485)
CAAGACATCCAGATGACCCAGTCTCCAGGCACCCTATCTTTGTCTCCAGG
GGGGAGCCACCCTCTCCTGCAGGGCCAGTCAGAGTGTTTCCAGCAGCCAG
TTAGCCTGGTACCAGCATAACGTGGCCAGCCTCCCAGGCTCCTCATCTAT
GGTGCATCCAGCAGGGCCACTGGCATCCCAGACAGGTTCAGTGGCAGTGG
GTCTGGGACAGACTACATTCTCACCATCAGCAGACTGGAGCCTGAAGATT
TTGCAGTGTATTACTGTCAGCATTTTGGTAGTTCACCTCCGGCGACGTTC
GGCCAAGGGACCAAGGTGGAAATCAAA H-Variable (AA):
(SEQ ID NO: 486)
EVQLLESGGGLVQPGGSLRLSCAASGFTFSSYKNWVRQAPGKGLEWVSSI
YPSGGVTIYASVKGRFTISRDNSKNTLYLQNNSLRAEDTAVYYCARDGSS
SGWYNPRRAFDYWGQGTLVTSS H-Variable (DNA):
(SEQ ID NO: 487)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACAAGA
TGGTTTGGGTTCGCCAAGCTCCTGGTAAAGGTTTGGAGTGGGTTTCTTCT
ATCTATCCTTCTGGTGGCGTTACTATTTATGCTGACTCCGTTAAAGGTCG
CTTCACTATCTCTAGAGACAACTTAAGAATACTCTCTACTTGCAGATGA
ACAGCTTAAGGGCTGAGGACACGGCCGTGTATTACTGTGCGAGAGATGGA
AGTAGCAGTGGCTGGTACAATCCCCGTAGGGCCTTTGACTACTGGGGCCA
GGGAACCCTGGTCACCGTCTCAAGC 82. 806C-M0055-E06
L-Variable (AA):
(SEQ ID NO: 488)
QYELTQPPSLSVSPGQTVKITCSAEKLSEKYVAWYQQRPGQSPVMIYQD
SRRPSGIPERFSGSNSGNTATLTISGTQPHDEADYYCQAWFSDSLPFGSG
TKVTVL -continued L-Variable (DNA):
(SEQ ID NO: 489)
CAGTACGAATTGACTCAGCCACCCTCTCTGTCCGTGTCCCCAGGACAGAC
AGTCAAGATCACCTGCTCTGCAGAGAAGTTGAGTGACAAATATGTTGCTT
GGTATCAAAACAGAGGCCGGGCCAGCTCCCCTGTCATGGTCATCTATCAAG
ATAGTAGGCGGCCCTCAGGGATCCCTGAGCGATTCTCTGGCTCCAACTCT
GGGAACACAGCCACTCTGACCATCAGCGGGACCCAGCCCATGGATGAGGC
TGACTACTATTGTCAGGCGTGGTTTAGCGACAGTCTCCCCTTTGGAAGTG
GGACCAAGGTCACCGTCCTA H-Variable (AA):
(SEQ ID NO: 490)
EVQLLESGGGLVQPGGSLRLSCAASGFTFSKYKNIWVRQAPGKGLEWVSS
IYPSGGHTIYADSVKGRETISRDNSKNTLYLQMNSLRAEDTAIIYYCARE
GGGATSFDYWGQGTLVTVSS H-Variable (DNA):
(SEQ ID NO: 491)
GAAGTTCAATTGTTAGAGTCTGGTGGCGGTCTTGTTCAGCCTGGTGGTTC
TTTACGTCTTTCTTGCGCTGCTTCCGGATTCACTTTCTCTAAGTACAAGA
TGATCTGGGTTCGCCAAGCTCCTGGTAAAGGTTTGGAGTGGGTTTCTTCT
ATCTATCCTTCTGGTGGCCATACTATTTATGCTGACTCCGTTAAAGGTCG
CTTCACTATCTCTAGAGACAACTCTAAGAATACTCTCTACTTGCAGATGA
ACAGCTTAAGGGCTGAGGACACCGCCATGTATTACTGTGCGAGAGAGGGC
GGGGGAGCTACCTCCTTTGACTACTGGGGCCAGGGAACCCTGGTCACCGT
CTCAAGC 83. 806C-M0055-E10
L-Variable (AA):
(SEQ ID NO: 492)
QDIQMTQSPATLSLSPGERATLSCRASQSVRTYLGWYQQKHGQAPRLLIY
DASNRATGIPARFSGSGSGTDFTLTISSLEPEDFAVYYCQQRSNWPLTFG
GGTKVEIK L-Variable (DNA):
(SEQ ID NO: 493)
CAAGACATCCAGATGACCCAGTCTCCAGCCACCCTGTCTTTGTCTCCAGG
GGAAAGAGCCACCCTCTCCTGCAGGGCCAGTCAGAGTGTTAGGACCTATT
TAGGCTGGTACCAACAGAAACATGGCCAGGCTCCCAGGCTCCTCATCTAT
GATGCATCCAACAGGGCCACTGGCATCCCAGCCAGGTTCAGTGGCAGTGG
GTCTGGGACAGACTTCACTCTCACCATCAGCAGCCTAGAGCCTGAAGATT
TTGCAGTTTATTACTGTCAGCAGCGTAGCAACTGGCCGCTCACTTTCGGC
GGAGGGACCAAGGTGGAGATCAAA H-Variable (AA):
(SEQ ID NO: 494)
EVQLLESGGGLVQPGGSLRLSCAASGFTFSAYPMFWVRQAPGKGLEWVSV
ISPSGGQTSYADSVKGRFTISRDNSKNTLYLQMNSLRAEDTAVYYCAKSF
SGLAALDFWGQGTLVTVSS H-Variable (DNA):
(SEQ ID NO: 495)
GAAGTTCAATTGTTAGAGTCTGGTGGCGGTCTTGTTCAGCCTGGTGGTTC
TTTACGTCTTTCTTCCGCTGCTTCCGGATTCACTTTCTCTGCTTACCCTA
TGTTTTGGGTTCGCCAAGCTCCTGGTAAAAGGTTTGCAGTGGGTTTCTGT
TATCTCTCCTTCTGGTGGCCAGACTTCTTATGCTGACTCCGTTAAAGGTC
GCCTTCACTATCTCTAGAGACAACTCTAAGAATACTCTCTACTTGCACATG
AACAGCTTAAGGGCTGAGGACACGGCCGTGTATTACTGTGCGAAATCATT
CTCAGGCTTAGCAGCTCTTGACTTCTGGGGCCAGGGAACCCTGGTCACCG
TCTCAAGC 84. 806C-M0055-E12
L-Variable (AA):
(SEQ ID NO: 496)
QDIQMTQSPGTLSLSPGERATLSCRASQTVSSGSLAWYQQKPGLAPRLLI
YGASRRGTGIPDRFSGSGSGTDFTLTISRLEPEDFAVYYCQQYGSTLPLT
FGGGTKVEIK L-Variable (DNA):
(SEQ ID NO: 497)
CAAGACATCCAGATGACCCAGTCTCCAGGCACCCTGTCTTTGTCTCCAGG
GGAAAGAGCCACCCTCTCCTGCAGGGCCAGTCAGACAGTGAGCAGCGGCT
CCTTAGCCTGGTACCAGCAGAAACCTGGCCTGGCTCCCAGGCTCCTCATC
TATGGTGCATCCCGTAGGGGCACTGGCATCCCAGACAGGTTCAGTGGCAG
TGGGTCTGGGACAGACTTCACTCTCACCATCAGCAGACTGGAGCCTGAAG
ATTTTGCAGTGTACTACTGTCAGCAGTATGGTAGTACACTCCCGCTCACT
TTCGGCGGAGGGACCAAGGTCGAGATCAAA H-Variable (AA):
(SEQ ID NO: 498)
EVQLLESGGGLVQPGGSLRLSCAASGFTFSQYTMYWVRQAPGKGLEWVSS
IYPSGGWTNYADSVKGRFTISRDNSKNTLYLQMNSLRAEDMAVYYCARGR
GGSKAFDIWGQGTMVTVSS H-Variable (DNA):
(SEQ ID NO: 499)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCAGTACACTA
TGTATTGGGTTCGCCAAGCTCCTGGTAAAGGTTTGGAGTGGGTTTCTTCT
ATCTATCCTTCTGGTGGCTGGACTAATTATGCTGACTCCGTTAAAGGTCG
CTTCACTATCTCTAGAGACAACTCTAAGAATACTCTCTACTTGCAGATGA
ACAGCTTAAGGGCTGAGGACATGGCTGTGTATTACTGTGCGAGAGGCCGT
GGTGGTAGCAAAGCTTTTGATATCTGGGGCCAAGGGACAATGGTCACCGT
CTCAAGC 85. 806C-M0055-F10
L-Variable (AA):
(SEQ ID NO: 500)
QSELTQPASVSCSPGQSITISCTGTTSDVGGYNYVSWYQQDPGKVPKLII
YEVYNRPSGVSNRFSGSKSGNTASLTISGLRAEDEADYYCSSKTSSVTYV
FGTCTKVTVL L-Variable (DNA):
(SEQ ID NO: 501)
CAGAGCGAATTGACTCAGCCTGCCTCCGTGTCTGGGTCTCCTGGACAGTC
GATCACCATCTCCTGCACTGGAACCACCAGTGACGTTGGTGGTTATAACT
ATGTCTCCTGGTATCAACAGGACCCAGGCAAAGTCCCCAAACTCATAATT
TATGAGGTCTATAATCGGCCCTCAGGGGTTTCAAATCGCTTCTCTGGCTC
CAAGTCTGGCAACACGGCTTCCCTGACCATCTCTGGCCTCCGGGCTGAGG
ACGAGGCTGATTATTACTGCAGCTCAAAAACAAGCAGCGTCACTTATGTC
TTTGGAACTGGGACCAAGGTCACCGTCCTA H-Variable (AA):
(SEQ ID NO: 502)
EVQLLESGGGLVQPGGSLRLSCAASGFTFSAYVMSWVRQAPGKGLEWVSR
IYPSGGGTRYADSVKGRFTISRDNSKNTLYLQMNSLRAEDTAVYYCAKEA
GGSYFLDYWGQGTLVTVSS H-Variable (DNA):
(SEQ ID NO: 503)
GAAGTTCAATTGTTAGAGTCTGGTGGCGGTCTTGTTCAGCCTGGTGGTTC
TTTACGTCTTTCTTGCGCTGCTTCCGGATTCACTTTCTCTGCTTACGTTA
TGTCTTGGGTTCGCCAAGCTCCTGGTAAGGTTTGGAGTGGGTTTCTCGTA
TCTATCCTTCTGGTGGCGGTACTCGTTATGCTGACTCCGTTAAAGGTCGC
TTCACTATCTCTAGAGACAACTCTAAGAATACTCTCTACTTGCAGATGAA
CAGCTTAAGGGCTGAGGACACGGCCGTGTATTACTGTGCGAAAGAGGCGG
GTGGGAGCTACTTCCTTGACTACTGGGGCCAGGGAACCCTGGTCACCGTC
TCAAGC 86. 806C-M0055-G02
L-Variable (AA):
(SEQ ID NO: 504)
QSELTQPRSVSGSLGQSVTISCTGTTSDVGRYNFVSWYQQYPGRAPKLII
HDVTRRPSGVSDRFSGSKSGNTASLTISGLQAEDEADYYCCSYAGSFYVF
GSGTQVTVL L-Variable (DNA):
(SEQ ID NO: 505)
CAGAGCGAATTGACTCAGCCTCCCTCAGTGTCCGGGTCTCTTGGACAGTC
AGTCACCATCTCCTGCACTGGAACCACCAGTGATGTTGGTCGTTATAACT
TTGTCTCCTGGTACCAACAGTATCCAGGCAGACCCCCAAACTCATCATT
CATGATGTCACTCGGCGGCCCTCCGGGGTATCTGATCGCTTCTCTGGCTC
CAAGTCCGGCAACACGGCCTCCCTGACCATCTCTGGTCTCCACGCTGAGG
ATGAGGCTGATTATTACTGCTGCTCATATGCAGGCAGCTTTTATGTCTTC
GGATCTGGGACCCAGGTCACCGTCTTG H-Variable (AA):
(SEQ ID NO: 506)
EVQLLESGGGLVQPGGSLRLSCAASGFTFSSYKNIWVRQAPGKGLEWVSG
IYPSGGATGYADSVKGRFTISRDNSKNTLYLQMNSLRAEDTATYYCARDG
GDIWPDYWGQGTLVTVSS H-Variable (DNA):
(SEQ ID NO: 507)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACAAGA
TGATTTGGGTTCGCCAAGCTCCTGGTAAAGGTTTGGAGTGGGTTTCTGGT
ATCTATCCTTCTCGTGGCGCTACTGGTTATGCTGACTCCGTTAAAGGTCG 87. 806C-M0055-G03
L-Variable (AA):

(SEQ ID NO: 508)
QYELTQPPSASGTPGQRVTISCSGSSSNIGTNTVYWYQQLPGTAPKLLIY
TNVQRPSGVPDRFSGSKSGTSASLAISGLQSEDEADYYCQSYDGSLSSAV
FGGGTQLTVL

L-Variable (DNA):

(SEQ ID NO: 509)
CAGTACGAATTGACTCAGCCACCCTCAGCGTCTGGGACCCCCGGGCAGAG
GGTCACCATCTCTTGTTCTGGAAGCAGCTCCAACATCGGAACTAATACTG
TATACTGGTACCAGCAGCTCCCAGGAACGGCCCCCAAACTCCTCATCTAT
ACTAATGTCCAGCGGCCCTCAGGGGTCCCTGACCGATTCTCTGGCTCCAA
GTCTGGCACCTCAGCCTCCCTGGCCATCAGTGGGCTCCAGTCTGAGGATG
AGGCTGATTATTACTGCCAGTCCTATGACGGCAGCCTGAGTTCTGCTGTG
TTCGGAGGAGGCACCCAGCTGACCGTCCTC

H-Variable (AA):

(SEQ ID NO: 510)
EVQLLESGGGLVQPGGSLRLSCAASGFTFSKYHMGWVRQAPGKGLEWVSS
IYSSGGITQYADSVKGRFTISRDNSKNTLYLQNNSLRAEDTAVYYCARGR
VGGWSLFNWFDPWGQGTLVTVSS

H-Variable (DNA):

(SEQ ID NO: 511)
GAAGTTCAATTGTTAGAGTCTGGTGGCGGTCTTGTTCAGCCTGGTGGTTC
TTTACGTCTTTCTTGCGCTGCTTCCGGATTCACTTTCTCTAAGTACCATA
TGGGTTGGGTTCGCCAAGCTCCTGGTAAAGGTTTGGAGTGGGTTTCTTCT
ATCTATTCTTCTGGTGGCATTACTCAGTATGCTGACTCCGTTAAAGGTCG
CTTCACTATCTCTAGAGACAACTCTAAGAATACTCTACTTGCAGATGA
ACAGCTTAAGGGCTGAGGACACGGCCGTGTATTACTGTGCAAGAGGCCGA
GTCGGTGGCTGGTCCCTTTTTAACTGGTTCGACCCCTGGGGCCAGGGCAC
CCTGGTCACCGTCTCAAGC 88. 806C-M0055-H04
L-Variable (AA):

(SEQ ID NO: 512)
QDIQMTQSPGTLSLSPGERATLSCRASQSVSSYLAWYQQKPGQAPRLLIY
DASNRATCIPARFSGSGSCTDFTLTISSLEPEDFAVYYCQQRSNWPRTFG
QGTKVEIK

L-Variable (DNA):

(SEQ ID NO: 513)
CAAGACATCCAGATGACCCAGTCTCCAGGCACCCTGTCTTTCTCTCCAGG
GGAAAGAGCCACCCTCTCCTGCAGGGCCAGTCAGAGTGTTAGCAGCTACT
TAGCCTGGTACCAACAGAAACCTGGCCAGGCTCCCAGGCTCCTCATCTAT
GATGCATCCAACAGGGCCACTGGCATCCCAGCCAGGTTCAGTGGCAGTGG
GTCTGGGACAGACTTCACTCTCACCATCAGCAGCCTAGAGCCTGAAGATT
TTGCAGTTTATTACTGTCAGCAGCGTAGCAACTGGCCTCGCACGTTCGGC
CAAGGGACCAAGGTGGAAATCAAA

H-Variable (AA):

(SEQ ID NO: 514)
EVQLLESGGGLVQPGGSLRLSCAASGFTFSSYPMYWVRQAPGKGLEWVSR
IVPSGGWTNYADSVKGRFTISRDNSKNTLYLQMNSLRAEDTAVYYCARDK
GDWYFDLWGRGTLVTVSS

H-Variable (DNA):

(SEQ ID NO: 515)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACCCTA
TGTATTGGGTTCGCCAAGCTCCTGGTAAGGTTTGGAGTGGGTTTCTCGTA
TCGTTCCTTCTGGTGGCTGGACTAACTATGCTGACTCCGTTAAAGGTCGC
TTCACTATCTCTAGAGACAACTCTAAGAATACTCTACTTGCAGATGAA
CAGCTTAAGGGCTGAGGACACGGCCGTGTATTACTGTGCGAGAGATAAGG
GGGACTGGTACTTCGATCTCTGGGGCCGTGGCACCCTGGTCACCGTCTCA
AGC 89. 806C-M0056-A01
L-Variable (AA):

(SEQ ID NO: 516)
QDIQMTQSPATLSLSPGERATLSCRASQSVSRYLAWYQQKPGQAPRLLIY
DTSNEATGIPARFSGSGSGTDFTLTISSLEPEDFAIYYCQQRSNWPPALT
FGGGTKVEIK

L-Variable (DNA):

(SEQ ID NO: 517)
CAAGACATCCAGATGACCCAGTCTCCAGCCACCCTGTCTCTGTCTCCAGG
GGAGAGAGCCACCCTCTCCTGCAGGGCCAGTCAGAGTGTTAGCAGGTACT
TAGCCTGGTATCAACAAAAACCTGGCCAGGCTCCCAGGCTCCTCATCTAT
GATACATCCAACAGGGCCACTGGCATCCCAGCCAGGTTCAGTGGCAGTGG
GTCTGGGACAGACTTCACTCTCACCATCAGCAGCCTAGAGCCTGAAGATT
TTCCAATTTATTACTGTCAGCAGCGTAGCAACTGGCCTCCGGCGCTCACT
TTCGGCGGAGGGACCAAGGTGGAGATCAAA

H-Variable (AA):

(SEQ ID NO: 518)
EVQLLESGGGLVQPGGSLRLSCAASCFTFSRYANCWVRQAPGKGLEWVSW
IYPSGGITSYADSVKGRFTISRDNSKNTLYLQMNSLRAEDTAMYYCARIT
YFDTSVTDYWGQGTLVTVSS

H-Variable (DNA):

(SEQ ID NO: 519)
GAAGTTCAATTGTTACAGTCTGGTGGCGGTCTTGTTCAGCCTGGTGGTTC
TTTACGTCTTTCTTGCGCTGCTTCCGGATTCACTTTCTCTCGTTACGCTA
TGGGTTGGGTTCGCCAAGCTCCTGGTAAAGGTTTGGAGTGGGTTTCTTGG
ATCTATCCTTCTGGTGGCATTACTTCTTATGCTGACTCCGTTAAAGGTCG
CTTCACTATCTCTAGAGACAACTCTAACAATACTCTCTACTTCCAGATGA
ACAGCTTAAGGGCTGAGGACACCGCCATGTATTACTGTGCACGGATTACG
TATTTTGATACCAGCGTTATTGACTACTGGGGCCAGGGAACCCTGGTCAC
CGTCTCAAGC 90. 806C-M0056-A06
L-Variable (AA):

(SEQ ID NO: 520)
QSVLTQPASVSGSPGQSITISCTGTSSNVGNYNLVSWYQQHPGKAPKLMI
YEDNKRPSGVSNRFSVSKSGNTASLTISGLQTEDEAEYYCCSYAGSGTWC
FGRRGTRVTV

L-Variable (DNA):

(SEQ ID NO: 521)
CAGAGCGTCTTGACTCAGCCTGCCTCCCTGTCTGGGTCTCCTGGACAGTC
CATCACCATCTCCTGCACTGGAACCAGCAGTAATGTTGGGAATTATAACC
TTGTCTCCTGGTACCAGCAGCACCCAGGCAAAGCCCCCAAACTCATGATT
TATGAGGACAATAAGCGGCCCTCAGGGGTTTCTAATCGCTTCTCTGTGTC
CAAGTCTGGCAACACGGCCTCCCTGACAATCTCTGGGCTCCAGACTGAGG
ACGAGGCTGAATATTACTGCTGCTCATATGCAGGTAGTGGCACTTGGTGT
TTCGGGCGGAGGGGAACCAGACTGACCGTC

H-Variable (AA):

(SEQ ID NO: 522)
EVQLLESGGGLVQPGGSLRLSCAASGFTFSHYPMEWVRQAPGKGLEWVSR
IVPSGGWTTYADSVKGRFTISRDNSKNTLYLQNNSLRAEDTAVYYCASRV
VTTYLDYFDYWGQGTLVTVSS

H-Variable (DNA):

(SEQ ID NO: 523)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCATTACCCTA
TGGAGTGGGTTCGCCAAGCTCCTGGTAAAGGTTTGGAGTGGGTTTCTCGT
ATCGTTCCTTCTGGTGGCTGGACTACTTATGCTCACTCCGTTAAAGGTCG
CTTCACTATCTCTAGAGACAACTCTAAGAATACTCTACTTGCAGATGA
ACAGCTTAAGGGCTGAGGACACGGCCGTGTATTACTGTGCGAGTCGGGTG
GTAACTACCTACTTAGACTACTTTGACTACTGGGGCCAGGGAACCCTGGT
CACCGTCTCAAGC 91. 806C-M0056-B08
H-Variable (AA):

(SEQ ID NO: 524)
EVQLLESGGGLVQPGGSLRLSCAASGFTFSVYVMSWVRQAPGKGLEWVSS
IYPSGGGTYYADSVKGRFTISRDNSKNTLYLQMNSLRAEDTATYYCARRK
AAAGYLDYWGQGTLVTVSS

H-Variable (DNA):

(SEQ ID NO: 525)
GAAGTTCAATTGTTAGAGTCTGGTGGCGGTCTTGTTCAGCCTCGTGGTTC
TTTACGTCTTTCTTGCGCTGCTTCCGGATTCACTTTCTCTGTTTACGTTA
TGTCTTGGGTTCGCCAAGCTCCTGGTAAAGGTTTGGAGTGGGTTTCTTCT
ATCTATCCTTCTGGTGGCGGTACTTATTATGCTGACTCCGTTAAAGGTCG
CTTCACTATCTCTAGAGACAACTCTAAGAATACTCTACTTGCAGATGA
ACAGCTTAAGGGCTGAGGACACAGCCACATATTACTGTGCGAGACGAAAA
GCAGCAGCAGGTTACCTTGACTACTGGGGCCAGGGAACCCTGGTCACCG
TCTCAAGC

-continued

L-Variable (AA):
(SEQ ID NO: 526)
QSALTQPASVSGSPGQSITISCTGTSSDIGAYKHVSWYQQHPGKAPKLMI
YEVTNRPSGISNRFSGSKSGNTASLTISGLQAEDEADYYCSSYTSRNTWV
FGGGTKLTVL L-Variable (DNA):
(SEQ ID NO: 527)
CAGAGCGCTTTGACTCAGCCTGCCTCCGTGTCTGGGTCTCCTGGACACTC
GATCACCATTTCCTGCACTGGAACTAGCAGTGACATTGGTGCTTATAAAC
ATGTCTCCTGGTATCAACAACACCCAGGCAAAGCCCCCAAACTCATGATT
TATGAGGTCACTAATCGGCCCTCAGGGATTTCTAATCGTTTCTCGGCTC
CAAGTCTGGCAACACGGCCTCCCTGACCATCTCTGGGCTCCAGGCTGAGG
ACGAGGCTGATTATTACTGCAGTTCATATACAAGCCGTAACACTTGGGTA
TTTCGCGGACGGACCAAGCTGACCGTCCTA 92. 806C-M0056-B09
L-Variable (AA):
(SEQ ID NO: 528)
QDIQMTQSPGTLSLSPGERATLSCRASQSVSSSYLAWYQQKPGQAPRLLI
YDASSEATGIPDRFSGSGSGTDFTLTISRLEPEDFAVYYCQQYGRSPSFG
PGTKVDIK L-Variable (DNA):
(SEQ ID NO: 529)
CAAGACATCCAGATGACCCAGTCTCCAGGCACCCTGTCTTTGTCTCCAGG
GGAAAGAGCCACCCTCTCCTGCAGGGCCAGTCAGACTGTTAGCAGCAGCT
ACTTAGCCTGGTACCAGCAGAAACCTGGCCAGGCTCCCAGGCTCCTCATC
TATGATGCATCCAGTAGGGCCACTGGCATCCCAGACAGGTTCAGTGGCAG
TGGGTCTGGGACAGACTTCACTCTCACCATCAGCAGACTGGAGCCTGAAG
ATTTTGCAGTGTATTACTGTCAGCAGTATGGTACGTCACCCTCTTTCGGC
CCTGGGACCAAAGTGGATATCAAA H-Variable (AA):
(SEQ ID NO: 530)
EVQLLESGGGLVQPGGSLRLSCAASGFTFSHYKMSWVRQAPGKGLEWVSS
IYPSGGWTYYADSVKGRFTISRDNSKNTLYLQMNSLRAEDMAVYYCARDR
PGAFDVWGQGTMVTVSS H-Variable (DNA):
(SEQ ID NO: 531)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCATTACAAGA
TGTCTTGCGTTCGCCAAGCTCCTGGTAAAGGTTTGGAGTGGGTTTCTTCT
ATCTATCCTTCTGGTGGCTGGACTTATTATGCTCACTCCGTTAAAGGTCC
CTTCACTATCTCTAGAGACAACTCTAAGAATACTCTCTACTTGCAGATGA
ACAGCTTAAGGGCTGAGGACATGGCTGTGTATTACTGTGCAAGAGATCGG
CCTGGAGCTTTTGATGTTTGGGGCCAAGGGACAATGGTCACCGTCTCAAG
C 93. 806C-M0056-C03
L-Variable (AA):
(SEQ ID NO: 532)
QDIQNTQSPGTLSLSPGERATLSCRASQSVSSSYLAWYQQKPGQAPRLLI
YGASSRATGIPDRFSGSGSGTDFTLTISRLEPDDSATYYCQQYNSYPITF
GQGTRLEIK L-Variable (DNA):
(SEQ ID NO: 533)
CAAGACATCCAGATGACCCACTCTCCAGGCACCCTGTCTTTGTCTCCAGG
GGAAAGAGCCACCCTCTCCTGCAGGGCCAGTCAGAGTGTTAGCAGCAGCT
ACTTAGCCTGGTACCAGCAGAAACCTGGCCAGGCTCCCAGGCTCCTCATC
TATGGTGCATCCAGCAGGGCCACTGGCATCCCAGACAGGTTCAGTGGCAG
TGGGTCTGGGACAGACTTCACTCTCACCATCAGCAGACTGGAGCCTGATG
ATTCTGCAACCTATTACTGCCAACAATATAATAGTTATCCGATCACCTTC
GGCCAAGGGACACGACTGGAGATTAAA H-Variable (AA):
(SEQ ID NO: 534)
EVQLLESGGGLVQPGGSLRLSCAASGFTFSSYKNWWVRQAPGKGLEWVSV
IYPSGGATYYADSVKGRFTISRDNSKNTLYLQMNSLRAEDTAVYYCARGI
GAVGGFDSWGQGTLVTVSS H-Variable (DNA):
(SEQ ID NO: 535)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACAAGA
ATTGGTGGCTTCGCCAAGCTCCTGGTAAAGGTTTGGAGTGGGTTTCTGTT
ATCTATCCTTCTGGTGGCGCTACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGGGATC
GGAGCAGTGGGCGGGTTTGACTCCTGGGGCCAGGGAACCCTGGTCACCGT
CTCAAGC 94. 806C-M0056-C04
L-Variable (AA):
(SEQ ID NO: 536)
QDIQMTQSPSSLSASVGDRVTIACRASHDISDNLNWYQQKPGRAPKVVIS
DAFNLEAGVPSRFSGSRSGTYFTFTINSLQPEDVATYYCQQFNNVPYTFG
QGTKLEIK L-Variable (DNA):
(SEQ ID NO: 537)
CAAGACATCCAGATGACCCAGTCTCCATCCTCCCTGTCTGCATCTGTAGG
AGACAGAGTCACCATCGCTTGCCGGGCGAGTCACGACATTAGTGACAATT
TAAATTGGTATCAGCAAAAACCAGGGAGAGCCCCTAAGGTCGTGATCTCC
GATGCATTCAATTTGGAAGCAGGGGTCCCATCAAGGTTCAGTGGAAGTAG
ATCTGGGACATATTTTACTTTCACCATCAACAGCCTGCAGCCTGAAGATG
TTGCAACATATTACTGTCAACAATTTAATAATGTCCCGTACACTTTTGGC
CAGGGGACCAAGCTGCAGATCAAA H-Variable (AA):
(SEQ ID NO: 538)
EVQLLESGGGLVQPGGSLRLSCAASGFTFSHYIMAWVRQAPGKGLEWVSR
IYPSGGKTYYADSVKGRFTISRDNSKNTLYLQMNSLRAEDTAVYYCARQG
GGGRAFDIWGQGTNVTVSS H-Variable (DNA):
(SEQ ID NO: 539)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCATTACATTA
TGGCTTGGGTTCGCCAAGCTCCTGGTAAAGGTTTGGAGTGGGTTTCTCGT
ATCTATCCTTCTGGTGGCAAGACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGACAGGGT
GGTGGTGGGCGTGCTTTTGATATCTGGGGCCAAGGGACAATGGTCACCGT
CTCAAGC 95. 806C-M0056-E08
L-Variable (AA):
(SEQ ID NO: 540)
QSALTQDPAVSVALGQTVKITCQGDSLRNYYASWYQQKPGQAPIVVIYGK
NNRPSGIPDRFSGSRSGSTASLTITGAQAVDEADYYCSSRDTTNYRMEFG
GGTKLTVL L-Variable (DNA):
(SEQ ID NO: 541)
CAGAGCGCTTTGACTCAGGACCCTGCTGTGTCTGTGGCCTTGGGACAGAC
AGTCAAGATCACATGCCAAGGAGACAGTCTCAGAAATTATTATGCAAGCT
CGTACCAGCAGAAACCCAGGACAGGCCCCTATAGTTGTCATCTATGGTAAA
AACAACCGGCCCTCAGGGATCCCAGACCGCTTCTCTGGCTCCAGGTCAGG
AAGCACAGCTTCCTTGACCATCACTGGGGCTCAGGCGGTAGATGAGGCTG
ACTATTACTGTAGTTCCCGGGACACTACTAATTACCGCATGGAATTCGGC
GGAGGGACCAAGCTGACTGTCCTA H-Variable (AA):
(SEQ ID NO: 542)
EVQLLESGGGLVQPGGSLRLSCAASGFTFSSYIMAWVRQAPGKGLEWVSG
IYPSGGFTTYADSVKGRFTISRDNSKNTLYLQMNSLRAEDTAVYYCAKIA
GGAYHLDYWGQGTLVTVSS H-Variable (DNA):
(SEQ ID NO: 543)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACATTA
TGGCTTGGGTTCGCCAAGCTCCTGGTAAAGGTTTGGAGTGGGTTTCTGGT
ATCTATCCTTCTGGTGGCTTTACTACTTATGCTGACTCCGTTAAAGGTCG
CTTCACTATCTCTAGAGACAACTCTAAGAATACTCTCTACTTGCAGATGA
ACAGCTTAAGGGCTGAGGACACGGCTGTGTATTACTGTGCGAAAATTGCA
GGGGGAGCCTACCACCTTGATTACTGGGGCCAGGGAACCCTGGTCACCGT
CTCAAGC 96. 806C-M0056-F01
L-Variable (AA):
(SEQ ID NO: 544)
QDIQMIQSPATLSLSPGERATLSCRASQSVSSYLAWYQQKPGQAPRLLIY
DASNRATGIPARFSGSGSGTDFTLTISSLEPEDFAVYYCQQRSNWPPALT
FGGGTKVEIK -continued L-Variable (DNA):
(SEQ ID NO: 545)
CAAGACATCCAGATGATCCAGTCTCCAGCCACCCTGTCTTTGTCTCCAGG
GGGAAAGAGCCACCCTCTCCTGCAGGGCCAGTCAGAGTGTTAGCAGCACT
TAGCCTGGTACCAACAGAAACCTGGCCAGGCTCCCAGGCTCCTCATCTAT
GATGCATCCAACAGGGCCACTGGCATCCCAGCCAGGTTCAGTGGCAGTGG
GTCTGGGACAGACTTCACTCTCACCATCAGCAGCTAGAGCCTGAAGATT
TTGCAGTTTATTACTGTCAGCAGCGTAGCAACTGGCCTCCGGCCCTCACT
TTCGGCGGAGGGACCAAGGTGGAGATCAAA H-Variable (AA):
(SEQ ID NO: 546)
EVQLLESGGGLVQPGGSLRLSCAASGFTFSRYGMEWVRQAPGKGLEWVSS
IYPSGGWTYYADSVKGRFTISRDNSKNTLYLQMNSLRAEDTAVYYCARRG
SGRYFDYWGQGTLVTVSS H-Variable (DNA):
(SEQ ID NO: 547)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACGGTA
TGGAGTGGGTTCGCCAAGCTCCTGGTAAAGGTTTGGAGTGGGTTTCTTCT
ATCTATCCTTCTGGTGGCTGGACTTATTATGCTGACTCCGTTAAAGGTCG
CTTCACTATCTCTAGAGACAACTCTAACAATACTCTCTACTTGCAGATGA
ACAGCTTAAGGGCTGAGGACACGGCCGTGTATTACTGTGCGAGACGGGGT
AGTGGCCGGTACTTTGACTACTGGGGCCAGGGCACCCTGGTCACCGTCTC
AAGC 97. 806C-M0056-F02
L-Variable (AA):
(SEQ ID NO: 548)
QSELTQPPSASGSPGQSVTITCTGTSSDVGYYNYVSWYQQHPGKAPKLMI
FEVSNRPSGVPDRFSGSKSGNTASLTVSGLQAEDEAHYYCSSYAGSDNFV
FGSGTKVTVL L-Variable (DNA):
(SEQ ID NO: 549)
CAGAGCGAATTGACTCAGCCTCCCTCCGCGTCCGCGTCTCCTGGACAGTC
AGTCACCATCACCTGCACTGGAACCAGCAGTGACGTTGGTTATTATAACT
ATGTCTCCTGGTATCAACAACACCCAGGCAAAGCCCCCAAACTCATGATT
TTTGAGGTCAGTAATCGGCCCTCAGGGGTCCCTGATCGCTCTCTGGCTC
CAAGTCTGGCAACACGGCCTCCCTGACCGTCTCTGGGCTCCAGGCTGAGG
ATGAGGCTCATTATTACTGCAGCTCATATGCAGGCAGCGACAATTTTGTC
TTCGGAAGTGGGACCAAGGTCACCGTCTTA H-Variable (AA):
(SEQ ID NO: 550)
EVQLLESGGGLVQPGGSLRLSCAASGFTFSIYVMGWVRQAPGKGLEWVSS
IYPSGGYTWYADSVKGRFTISRDNSKNTLYLQMNSLRAEDTAVYYCARQG
GGGRAFDIWGQGTTVTVSS H-Variable (DNA):
(SEQ ID NO: 551)
GAAGTTCAATTGTTAGAGTCTGGTGGCGGTCTTGTTCAGCCTGGTGGTTC
TTTACGTCTTTCTTGCGCTGCTTCCGGATTCACTTTCTCTATTTACGTTA
TGGGTTGGGTTCCCCAAGCTCCTGGTAAAGGTTTGGAGTGGGTTTCTTCT
ATCTATCCTTCTGGTTATACTTGGTATGCTGACTCCGTTAAAGGTCG
CTTCACTATCTCTACAGACAACTCTAAGAATACTCTCTACTTGCAGATGA
ACAGCTTAAGGGCTGAGGACACGGCCGTGTATTACTGTGCGAGACAGGGA
GGAGGCGGTCGTGCTTTTGATATCTGGGGCCAAGGGACCACGGTCACCGT
CTCAAGC 98. 806C-M0056-F10
L-Variable (AA):
(SEQ ID NO: 552)
QSVLTQPASVSGSPGQSITISCTGTSSDVGGYNYVSWYQQHPGKAPKLMI
YDVSNRPSGVSNRFSCSKSGNTASLTISGLQAEDEADYYCSSYTSSSTLF
YVFGTGTKVTVL L-Variable (DNA):
(SEQ ID NO: 553)
CAGAGCGTCTTGACTCAGCCTGCCTCCGTGTCTGGGTCTCCTGGACAGTC
GATCACCATCTCCTGCACTGGAACCAGCAGTGACGTTGGTGGTTATAACT
ATGTCTCCTGGTACCAACAACACCCAGGCAAAGCCCCCAAACTCATGATT
TATGATGTCAGTAATCGGCCCTCAGGGGTTTCTAATCGCTTCTCTGGCTC
CAAGTCTGGCAACACGGCCTCCCTGACCATCTCTGGGCTCCAGGCTGAGG
ACGAGGCTGATTATTACTGCAGCTCATATACAAGCAGCAGCACTCTCTTT
TATGTCTTCGGAACTGGGACCAAGGTCACCGTCCTA H-Variable (AA):
(SEQ ID NO: 554)
EVQLLESGGGLVQPGGSLRLSCAASGFTFSRYKMNWVRQAPGKCLEWVSY
IVPSGGWTYYADSVKGRFTISNSTLYLQNNSLRAEDTAVYYCARVDYYDF
WSGYWWSGGYGMDVWGQGTTVTVSS H-Variable (DNA):
(SEQ ID NO: 555)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACAAGA
TGATGGGGTTCGCCAAGCTCCTGGTAAAGGTTTGGAGTGGGTTTCTTAT
ATCGTTCCTTCTGGTGGCTGGACTTATTATGCTGACTCCGTTAAAGGTCG
CTTCACTATCTCTAGAGACAACTCTAAGAATACTCTCTACTTGCAGATGA
ACAGCTTAACGGCTGAGGACACGGCCGTGTATTACTGTGCGAGAGTTGAC
TATTACCATTTTTGGAGTGGTTATTGGTGGTCGGGGGGGTACGGTATGGA
CCTCTGGGGCCAAGGGACCACGGTCACCGTCTCAAGC 99. 806C-M0056-F11
L-Variable (AA):
(SEQ ID NO: 556)
QDIQMTQSPSFLSASVGDRVTITCRASQCISTYLAWYQQKPGKAPKLLIY
ATSTLQSGVPSRFSGSCSGTEFTLAISTLQPEDFATYYCQQLNSYPITFG
QGTRLEIK L-Variable (DNA):
(SEQ ID NO: 557)
CAAGACATCCAGATGACCCAGTCTCCATCCTTCCTGTCTGCATCTGTAGG
AGACAGAGTCACCATCACTTGCCGGGCCAGTCAGGGCATAAGCACTTATT
TAGCCTGGTATCAGCAAAAGCCAGGGAAAGCCCCTAAGCTCTTGATCTAT
GCTACATCCACTTTGCAAAGTGGGGTCCCATCAAGGTTCAGCGGCAGTGG
GTCTGGGACAGAATTCACTCTCGCAATCAGCACCCTGCAGCCTGAAGATT
TTGCAACTTATTACTGTCAACAACTCAATAGTTACCCGATCACTTTCGGC
CAAGGGACGCGACTGGAGATTAAA H-Variable (AA):
(SEQ ID NO: 558)
EVQLLESGGGLVQPGGSLRLSCAASGFTFSRYVMLWVRQAPGKGLEWVSV
IYPSGGYTYYADSVKGRFTISRDNSKNTLYLQMNSLRAEDTAVYYCARGV
LRAFDIWGQGTMVTVSS H-Variable (DNA):
(SEQ ID NO: 559)
GAAGTTCAATTGTTAGAGTCTGGTGGCGCTCTTGTTCAGCCTGGTGGTTC
TTTACGTCTTTCTTGCGCTGCTTCCGGATTCACTTTCTCTCGTTACCTTA
TGCTTTGGGTTCGCCAAGCTCCTGGTAAAGGTTTGGAGTGGGTTTCTGTT
ATCTATCCTTCTGGTGGCTATACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGGGGTA
CTAAGAGCTTTTGATATCTGGGGCCAAGGGACAATGGTCACCGTCTCAAG
C 100. 806C-M0056-G03
L-Variable (AA):
(SEQ ID NO: 560)
QNIQMTQSPATLSLSPGERATLSCRASQSISSYLAWYQQKPGQVPRLLIY
DASNRATGIPARFSGSGSGTDFTLTISRLEPEDFAVYYCQQYGSLPRTFG
QGTKVEIK L-Variable (DNA):
(SEQ ID NO: 561)
CAAAACATCCAGATCACCCAGTCTCCAGCCACCCTGTCTTTGTCTCCAGG
GGAGAGAGCCACCCTCTCCTGCAGGGCCAGTCAGAGTATTAGCAGTTACT
TAGCCTGGTATCAACAGAAACCTGGCCAGGTTCCCAGGCTCCTCATCTAT
GATGCATCCAATAGGGCCACTGGCATCCCAGCCAGGTTCAGTGGCAGTGG
GTCTGGGACAGACTTCACTCTCACCATCAGCAGACTGGAGCCTGAAGATT
TTGCAGTTTATTACTGTCAGCAGTATGGTAGTTTACCTCGGACGTTCGGC
CAAGGGACCAAGGTGGAAATCAAA H-Variable (AA):
(SEQ ID NO: 562)
EVQLLESGGGLVQPGGSLRLSCAASCFTFSKYNHWVRQAPGKGLEWVSV
IYPSGGKTYYADSVKGRETISRNSKNTLYLQNNSLRAEDTAVYYCAREMG
GSGWYDYGQGTLVTVSS H-Variable (DNA):
(SEQ ID NO: 563)
GAAGTTCAATTGTTAGAGTCTGGTGGCGGTCTTGTTCAGCCTGGTGGTTC
TTTACGTCTTTCTTGCGCTGCTTCCGGATTCACTTTCTCTAAGTACAAGA
TGCATTGGGTTCGCCAAGCTCCTGGTAAGGTTTGGAGTGGGTTTCTGTTA
TCTATCCATCTGGTGGCAAGACTTATTATGCTGACTCCGTTAAAGGTCGC 101. 806C-M0056-G04
L-Variable (AA):
(SEQ ID NO: 564)
QDIQMTQSPATLSLSPGARATLSCRASQSVSSYLAWYQQRPGQTPRLLIY
GASSRATGIPDRFSGSGSGTDFTLTISRLEPEDFAVYYCQQYGSSRHTFG
QGTKLEIK L-Variable (DNA):
(SEQ ID NO: 565)
CAAGACATCCAGATGACCCAGTCTCCAGCCACCCTGTCTTTGTCTCCAGG
GGCAAGAGCCACCCTCTCCTGCAGGGCCAGTCAGAGTGTTAGCAGCTACT
TAGCCTGGTACCAACAGAGACCTGGCCAGACTCCCAGGCTCCTCATCTAT
GGTGCATCCAGCAGGGCCACTGGCATCCCAGACAGGTTCAGTGGCAGTGG
GTCTGGGACAGACTTCACTCTCACCATCAGCAGACTGGAGCCTGAAGATT
TTGCAGTGTATTACTGTCAGCAGTATGGTAGCTCACGACACACTTTTGGC
CAGGGGACCAAGCTGGAGATCAAA H-Variable (AA):
(SEQ ID NO: 566)
EVQLLESGGGLVQPGGSLRLSCAASGFTFSQYVMRWVRQAPGKGLEWVSG
IYPSGGWTTYADSVKGRFTISRDNSKNTLYLQMNSLRAEDTAVYYCATVA
AAAGAFDIWGQGTMVTVSS H-Variable (DNA):
(SEQ ID NO: 567)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCAGTACGTTA
TGCGTTGGGTTCGCCAAGCTCCTGGTAAAGGTTTGGAGTGGGTTTCTGGT
ATCTATCCTTCTGGTGGCTGGACTACTTATGCTGACTCCGTTAAAGGTCG
CTTCACTATCTCTAGAGACAACTCTAAGAATACTCTCTACTTGCAGATGA
ACAGCTTAAGGGCTGAGGACACCGCCGTGTATTACTGTGCAACAGTGGCA
GCAGCTGCGGGGCTTTTGATATCTGGGGCCAAGGGACAATGGTCACCGT
CTCAAGC 102. 806C-M0056-G08
L-Variable (AA):
(SEQ ID NO: 568)
QDIQMTQSPGTLSLSPGERATLSCRASQSISSSYLAWYQQKPGQAPRLLL
YGTSNRATGIPDRFSGSGSGTDFTLTISRLEPEDFALYYCQQRYKWPLTF
GPCTKVDFK L-Variable (DNA):
(SEQ ID NO: 569)
CAAGACATCCAGATGACCCAGTCTCCAGGCACCCTGTCTTTGTCTCCAGG
GGAAAGAGCCACCCTCTCCTGCAGGGCCAGTCAGAGTATTAGCAGCAGCT
ACTTAGCCTGGTACCAGCAGAAACCTGGCCAGGCTCCCGGCTCCTCCTC
TATGGTACATCCAACAGGGCCACTGGCATCCCAGACAGCTTCAGTGGCAG
TGGGTCTGGGACAGACTTCACTCTCACCATCAGCAGACTGGAGCCTGAAG
ACTTTGCACTTTATTACTGTCAGCAGCGTTACAAGTGGCCTCTCACTTTC
GGCCCTGGGACCAAGGTGGATTTCAAA H-Variable (AA):
(SEQ ID NO: 570)
EVQLLESGGGLVQPGGSLRLSCAASGFTFSHYGMWWVRQAPGKGLEWVSV
ISPSGGQTNYADSVKGRFTISRDNSKNTLYLQMNSLRAEDTAVYYCAXGQ
IHGGNLASWGQGTLVTVSS H-Variable (DNA):
(SEQ ID NO: 571)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCATTACGGTA
TGTGGTGGGTTCCCCAAGCTCCTGGTAAAGGTTTGGAGTGGGTTTCTGTT
ATCTCTCCTTCTGGTGGCCAGACTAATTATGCTGACTCCGTTAAAGGTCG
CTTCACTATCTCTAGAGACAACTCTAAGAATACTCTCTACTTGCAGATGA
ACAGCTTAAGGGCTGAGGACACTGCCGTGTATTACTGTGCCAAAGGGCAA
ATCCACGGTGGTAATCTTGCCTCCTGGGGCCAGGGAACCCTGGTCACCGT
CTCAAGC 103. 806C-M0056-G12
L-Variable (AA):
(SEQ ID NO: 572)
QSALTQPASVSGSPGQSITISCTGTSSDVGGYNYVSWYQQHPGKAPKLMI
SDVSNRPSGVSNRFSGSKSGNTASLTISGLQAEDEADYYCSSYTSSSTLY
VFGTGTKVTVL L-Variable (DNA):
(SEQ ID NO: 573)
CAGAGCGCTTTGACTCAGCCTGCCTCCGTGTCTGGGTCTCCTGGACAGTC
GATCACCATCTCCTGCACTGGAACTAGCAGCGACGTTGGTGGTTATAACT
ATGTCTCCTGGTACCAACAGCACCCAGGCAAAGCCCCCAAACTCATGATT
TCTGATGTCAGTAATCGGCCCTCAGGGGTTTCTAATCGCTTCTCTGGCTC
CAAGTCTGGCAACACGGCCTCCCTGACCATCTCTGGGCTCCACGCTGAGG
ACGAGGCTGATTATTACTGCAGCTCATATACAAGCAGCAGCACTCTGTAT
GTCTTCGGAACTGGGACCAAGGTCACCGTCCTA H-Variable (AA):
(SEQ ID NO: 574)
EVQLLESGGCLVQPGGSLRLSCAASGFTFSNYKMNWVRQAPGKGLEWVSV
IYPSGGATYYADSVKGRFTISRDNSKNTLYLQMNSLRAEDTAMYYCARVG
YSSSWDPHFDYWGQGTLVTVSS H-Variable (DNA):
(SEQ ID NO: 575)
CAAGTTCAATTGTTAGAGTCTGGTGGCGGTCTTGTTCAGCCTGGTGGTTC
TTTACGTCTTTCTTGCGCTGCTTCCGGATTCACTTTCTCTAATTACAAGA
TGAATTGGGTTCGCCAAGCTCCTGGTAAAGGTTTGGAGTGGGTTTCTGTT
ATCTATCCTTCTGGTGGCGCTACTTATTATGCTGACTCCGTTAAAGGTCG
CTTCACTATCTCTAGAGACAACTCTAAGAATACTCTCTACTTGCAGATGA
ACAGCTTAAGGGCTGAGGACACCGCCATGTATTACTGTGCGAGAGTCGGG
TATAGCAGCAGCTGGGACCCCACTTTGACTACTGGGGCCAGGGAACCCT
GGTCACCGTCTCAAGC 104. 806C-M0056-H04
L-Variable (AA):
(SEQ ID NO: 576)
QDIQMTQSPATLSLSPGERATLSCRASQSVSSSYLAWYQQKPGQAPRLLI
YGASSRATGIPDRFSGSGSGTEFTLTISSLQSEDFGVYYCQQYKDWPRTF
GQGTKVEIK L-Variable (DNA):
(SEQ ID NO: 577)
CAAGACATCCAGATGACCCAGTCTCCAGCCACCCTGTCTTTGTCTCCAGG
GGAAAGAGCCACCCTCTCCTGCAGGGCCAGTCAGAGTGTTAGCAGCAGCT
ACTTAGCCTGGTACCAGCAGAAACCTGGCCAGGCTCCCAGGCTCCTCATC
TATGGTGCATCCAGCAGGGCCACTGGCATCCCAGACAGGTTCAGTGGCAG
TGGGTCTGGGACAGAGTTCACTCTCACCATCAGCAGCCTGCAGTCTGAAG
ATTTTGGAGTTTATTATTGTCAGCAGTATAAGGACTGGCCTCGAACGTTC
GGCCAAGGGACCAAGGTGGAAATCAAA H-Variable (AA):
(SEQ ID NO: 578)
EVQLLESGGCLVQPGGSLRLSCAASGFTFSSYRNVWVRQAPGKGLEWVSS
IYPSGGPTRYADSVKGRETISRDNSKNTLYLQNNSLRAEDTAVYYCARWS
YYYDSSGYYPVSGPFDIWGQGTMVTVSS H-Variable (DNA):
(SEQ ID NO: 579)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACCGTA
TGGTTTGGGTTCGCCAAGCTCCTGGTAAAGGTTTGGAGTGGGTTCTTCT
ATCTATCCTTCTGGTGGCCCTACTCGTTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGATGGTCG
TATTACTATGATAGTAGTGGTTATACCCCGTGAGTGGGCCTTTTGATAT
CTGGGGCCAAGGGACAATGGTCACCGTCTCAAGC 105. 806C-M0056-H12
L-Variable (AA):
(SEQ ID NO: 580)
QDIQMTQSPGTLSLSPCERATLSCRASQGVRSTYLAWYQQKPGQAPRLLI
YGASSRATGIPDRFSGSGSGTDFTLTISRLEPEDFAXTYYCQQYGSSQGF
TFGPGTKVDIK L-Variable (DNA):
(SEQ ID NO: 581)
CAAGACATCCAGATGACCCAGTCTCCAGGCACCCTGTCTTTGTCTCCAGG
GGAAAGAGCCACCCTCTCCTGCAGGGCCAGTCAGGGTGTTAGAAGTACCT
ACTTAGCCTGGTACCAGCAGAAACCTGGCCAGGCTCCCAGGCTCCTCATC
TATGGTGCATCCAGCAGGGCCACTGGCATCCCAGACAGGTTCAGTGGCAG
TGGGTCTGGGACAGACTTCACTCTCACCATCAGCAGACTGGAGCCTGAAG
ATTTTGCAGTGTATTACTGTCAGCAGTATGGTAGCTCACAGGGTTTCACT
TTCGGCCCTGGGACCAAAGTGGATATCAAA -continued
H-Variable (AA):
(SEQ ID NO: 582)
EVQLLESGGGLVQPGGSLRLSCAASGFTFSMYKMHWVRQAPGKGLEWVSV
IYPSGGITAYADSVKGRFTISRDNSKNTLYLQMNSLRADDTAVYYCTREV
MGPSDYWGQGTLVTVSS H-Variable (DNA):
(SEQ ID NO: 583)
GAACTTCAATTGTTAGAGTCTGGTGGCGGTCTTGTTCAGCCTGGTCGTTC
TTTACGTCTTTCTTGCGCTGCTTCCGGATTCACTTTCTCTATGTACAAGA
TGCATTGGGTTCGCCAAGCTCCTGGTAAAGGTTTGGAGTGGGTTTCTCTT
ATCTATCCTTCTGGTGGCATTACTGCTTATGCTGACTCCGTTAAAGGTCG
CTTCACTATCTCTAGAGACAACTCTAAGAATACTCTCTACTTGCAGATGA
ACAGCTTAAGGGCTGATGACACAGCCGTGTATTACTGTACTAGAGAGGTT
ATGGGACCATCTGACTACTGGGGCCAGGGAACCCTGGTCACCGTCTCAAG
C 106. 806C-M0057-B05
L-Variable (AA):
(SEQ ID NO: 584)
QDIQMTQSPATLSVSPGERATLSCRSSQSLSNNLAWYQQKPGQAPRLLIY
GASTRATGIPARFSGSGSGTEFTLTISSLQSEDFATYYCQQANSFPRTFG
QGTKLEIK L-Variable (DNA):
(SEQ ID NO: 585)
CAAGACATCCAGATGACCCAGTCTCCAGCCACCCTGTCTGTGTCTCCAGG
GGAAAGAGCCACCCTCTCCTGCAGGTCCAGTCAGAGTCTTAGCAACAACT
TAGCCTGGTACCAGCAGAAACCTGGCCAGCCTCCCAGGCTCCTCATCTAT
GGTGCATCCACCAGGGCCACTGGCATCCCAGCAGGTTCAGTGGCAGTGG
GTCTGGGACAGAGTTCACTCTCACCATCAGCAGCTGCAGTCTGAAGATT
TTGCAACTTACTATTGTCAACAGGCTAACAGTTTCCCTCGAACTTTTGGC
CAGGGGACCAAGCTGGAGATCAAA H-Variable (AA):
(SEQ ID NO: 586)
EVQLLESGGGLVQPGGSLRLSCAASGFTFSKYVMHWVRQAPGKGLEWVSS
IYPSGGWTYYADSVKGRFTISRDNSKNTLYLQMNSLRAEDTAVYYCATST
TYSSRPFDYWGQCTLVTVSS H-Variable (DNA):
(SEQ ID NO: 587)
GAAGTTCAATTGTTAGACTCTGGTGGCGGTCTTGTTCAGCCTGGTGGTTC
TTTACGTCTTTCTTGCCCTGCTTCCGGATTCACTTTCTCTAAGTACGTTA
TGCATTGGGTTCGCCAAGCTCCTGGTAAAGGTTTGGACTGGGTTTCTTCT
ATCTATCCTTCTGGTGGCTGGACTTATTATGCTGACTCGCCTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGACCTCTACG
ACTTATAGCAGCACGCCCTTTGACTATTGGGGCCAGGGAACCCTGGTCAC
CGTCTCAAGC 107. 806C-M0057-H07
L-Variable (AA):
(SEQ ID NO: 588)
QDIQMTQSPSSLSASVGDRVAITCRASQSIDTYLNWYQHKPGKAPKLLIY
AASKLEDGVPSRFSGSGTGTDFTLTIRSLQPEDFASYFCQQSYSSPGITF
GPGTKVEIK L-Variable (DNA):
(SEQ ID NO: 589)
CAAGACATCCAGATGACCCAGTCTCCATCCTCCCTGTCTGCATCTGTGGG
AGACAGAGTCGCCATCACTTGCCGCGCAAGTCAGAGCATCGACACCTATT
TAAATTGGTATCAGCACAAACCAGGGAAAGCCCCTAAACTCCTGATCTAT
GCTGCATCCAAGTTGGAACACGGGGTCCCATCAAGATTCAGTGGCAGTGG
AACTGGGACAGATTTCACTCTCACCATCAGAAGTCTGCAACCTGAAGATT
TTGCAAGTTATTTCTGTCAACAGAGCTACTCTACTCCAGGGATCACTTTC
GGCCCTGGGACCAAGGTGGAGATCAAA H-Variable (AA):
(SEQ ID NO: 590)
EVQLLESGGGLVQPGGSLRLSCAASGFTFSRYPMMWVRQAPGKGLEWVSV
IYSSGGYTYYADSVKGRETISRDNSKNTLYLQMNSLRAEDTAVYYCARVS
RGIYYAMDVWGQGTTVTVSS H-Variable (DNA):
(SEQ ID NO: 591)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACCCTA
TGATGTGGGTTCGCCAAGCTCCTGGTAAAGGTTTGGAGTGGGTTTCTGTT
ATCTATTCTTCTGGTGGCTATACTTATTATGCTGACTCCGTTAAAGGTCG -continued
CTTCACTATCTCTAGAGACAACTCTCTACTTGCAGATGA
ACAGCTTAAGGGCTGAGGACACGGCCGTGTATTACTGTGCGAGAGTATCT
CGCGGGATCTACTACGCTATGGACGTCTGGGGCCAAGGGACCACGGTCAC
CGTCTCAAGC 108. 806C-M0058-A09
L-Variable (AA):
(SEQ ID NO: 592)
QDIQMTQSPGTLSLSPGERATLSCRASQSVSSSYLAWYQQKPGQAPRLLI
YGASSRATGIPDRFSGSGSGTDFTLTISRLEPEDFVVYYCQQYGRSRYTF
GQGTKLEIK L-Variable (DNA):
(SEQ ID NO: 593)
CAAGACATCCAGATGACCCAGTCTCCAGGCACCCTGTCTTTGTCTCCAGG
GGAAAGAGCCACCCTCTCCTGCAGGGCCAGTCAGAGTGTTAGCAGCAGCT
ACTTAGCCTGGTACCAGCAGAAACCTGGCCAGGCTCCCAGGCTCCTCATC
TATGGTGCATCCAGCAGGGCCACTGGCATCCCAGACAGGTTCAGTGGCAG
TGGGTCTGGGACAGACTTCACTCTCACCATCAGCAGACTGGAGCCTGAAG
ATTTTGTAGTGTATTACTGTCAGCAGTATGGTAGGTCACGGTACACTTTT
GGCCAGCGGACCAAGCTCGAGATCAAA H-Variable (AA):
(SEQ ID NO: 594)
EVQLLESGGGLVQPGGSLRLSCAASGFTFSNYKMHWVRQAPGKGLEWVSS
TYPSCGPTHYADSVKGRFTISRINSKNTLYLQMNSLRAEDTAVYYCAREG
YSSGWYIHWYFDLWGRGTLVTVSS H-Variable (DNA):
(SEQ ID NO: 595)
GAAGTTCAATTGTTAGAGTCTGGTGGCGGTCTTGTTCAGCCTGGTGGTTC
TTTACGTCTTTCTTGCGCTGCTTCCGGATTCACTTTCTAATTACAAGA
TGCATTGGGTTCGCCAAGCTCCTGGTAAAGGTTTGGAGTGGGTTCTTCT
ATCTATCCTTCTGGTGGCCTACTACTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGAAGGG
TATAGCAGTGGCTGGTACATTCACTGGTACTTCGATCTCTGGGGCCGTGG
CACCCTGGTCACCGTCTCAAGC 109. 806C-M0058-D04
L-Variable (AA):
(SEQ ID NO: 596)
QDIQMTQSPSSLSASVGDRVAITCRASQSIDTYLNWYQQKPGKAPKLLIY
DASNLETGVPSRFSCSGSGTHFTFTISSLQPEDFATYYCQQADSFPITFG
QGTRLEIK L-Variable (DNA):
(SEQ ID NO: 597)
CAAGACATCCAGATGACCCAGTCTCCATCCTCCCTGTCTGCATCTGTGGG
AGACAGAGTCGCCATCACTTGCCGCGCAAGTCAGAGCATCGACACTTATT
TAAATTGGTATCAGCAGAAACCAGGGAAAGCCCCTAAGTCCTGATCTAC
GATGCATCCAATTTGGAAACAGGGGTCCCATCAAGGTTCAGTGAAGTGG
ATCTGGGACACACTTTACCTTCACCATCAGCACCCTGCAGCCTGAAGATT
TTGCAACTTACTATTGTCAGCAGGCTGACAGTTTCCCGATCACCTTCGGC
CAAGGGACACGACTGGAGATTAAA H-Variable (AA):
(SEQ ID NO: 598)
EVQLLESGGGLVQPGGSLRLSCAASGFTFSSYFMTWVRQAPGKGLEWVSG
ISPSGGITSYADSVKGRFTISRDNSKNTLYLQMNSLRAEDTAVYYCAKGS
YSDYGVFNSWGQGTLVTVSS H-Variable (DNA):
(SEQ ID NO: 599)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACTTTA
TGACTTGGGTTCGCCAAGCTCCTGGTAAAGGTTTGGAGTGGGTTTCTGGT
ATCTCTCCTTCTGGTGGCATTACTTCTTATGCTGACTCCGTTAAAGGTCG
CTTCACTATCTCTAGAGACAACTCTAAGAATACTCTCTACTTGCAGATGA
ACACCTTAAGGGCTGAGGACACGGCCGTGTATTACTGTGCGAAAGGCTCA
TACAGTGATTACGGGGTCTTTAATTCCTGGGGCCAGGGAACCCTGGTCAC
CGTCTCAAGC 110. 806C-M0058-E09
L-Variable (AA):
(SEQ ID NO: 600)
QDIQMTQSPATLSVSPGERATLSCRASQSISSSLAWYQQKPGQAPRLLIY
DASNRATGIPARFSGSGSGTDFTLTISSLEPEDFAVYYCQQRSNWPLTFG
GGTKVEIK L-Variable (DNA):
(SEQ ID NO: 601)
CAAGACATCCAGATGACCCAGTCTCCAGCCACCCTGTCTGTGTCTCCAGG
GGAAAGAGCCACCCTCTCCTGCAGGGCCAGTCAGAGTATTAGCAGCAGCT
TAGCCTGGTACCAGCAGAAACCTGGCCAGGCTCCCAGGCTCCTCATCTAT
GATGCATCCAACAGGGCCACTGGCATCCCAGCCAGGTTCAGTGGCAGTGG
GTCTGGGACAGACTTCACTCTCACCATCAGCAGCCTAGAGCCTGAAGATT
TTGCAGTTTATTACTGTCAGCAGCGTAGCAACTGGCCGCTCACTTTCGGC
GGAGGGACCAAGGTGGAGATCAAA H-Variable (AA):
(SEQ ID NO: 602)
EVQLLESGGGLVQPGGSLRLSCAASGFTFSNYVMAWVRQAPGKGLEWVSV
IYPSGGATYYADSVKGRFTISRDNSKNTLYLQNNSLRAEDTAVYYCTRLA
VTHFDYWGQGTLVTVSS H-Variable (DNA):
(SEQ ID NO: 603)
GAACTTCAATTGTTAGAGTCTGGTGGCGGTCTTGTTCAGCCTGGTGGTTC
TTTACGTCTTTCTTGCGCTGCTTCCGGATTCACTTTCTCTAATTACGTTA
TGGCTTGGGTTCGCCAAGCTCCTGGTAAAGGTTTGGAGTGGGTTTCTGTT
ATCTATCCTTCTGGTGGCGCTACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTACGAGACTGGCG
GTTACTCACTTTGACTACTGGGGCCAGGGAACCCTGGTCACCGTCTCAAG
C 111. 806C-M0058-F03
L-Variable (AA):
(SEQ ID NO: 604)
QDIQMTQSPSTLSASVGDRVTITCRASQGISNYLAWYQQKPGKVPKLLIY
GASNLQSGVSSRFSGSGSATDFTLTISSLQPEDFATYYCQQFNSYPLTFG
GGTKVEIK L-Variable (DNA):
(SEQ ID NO: 605)
CAAGACATCCAGATGACCCAGTCTCCTTCCACCCTGTCTGCATCTGTAGG
AGACAGAGTCACCATCACTTGCCGGGCGAGTCAGGGCATTAGCAATTATT
TAGCCTGGTATCAACAGAAACCAGGGAAAGTTCCTAAACTCCTGATCTAT
GGTGCATCTAATTTGCAGTCAGGGGTCTCATCTCGGTTCAGTGGCAGTGG
ATCTGCGACAGATTTCACCCTCACCATCAGCAGCCTGCAGCCTGAAGATT
TTGCAACTTATTACTGTCAACAGTTTAATAGTTACCCTCTGACTTTCGGC
CGAGGGACCAAGGTGGAGATCAAA H-Variable (AA):
(SEQ ID NO: 606)
EVQLLESGGGLVQPGCSLRLSCAASGFTFSDYGMAWVRQAPGKGLEWVSV
ISPSGGQTAYADSVKGRFTISRDNSKNTLYLQNNSLRAEDTAVYYCATVR
WFGAFDYWGQGTLVTVSS H-Variable (DNA):
(SEQ ID NO: 607)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCATTACGGTA
TGGCTTGGGTTCGCCAAGCTCCTGGTAAAGGTTTGGAGTGGGTTTCTGTT
ATCTCCCTTCTGGTGGACAGACTGCTTATGCTGACTCCGTTAAAGGTCG
CTTCACTATCTCTAGAGACAACTCTAAGAATACTCTCTACTTGCAGATGA
ACAGCTTAAGGGCTGAGGACACGGCTGTGTATTACTGTGCCACAGTTAGA
TGGTTCGGGGCATTTGACTACTGGGGCCAGGGAACCCTGGTCACCGTCTC
AAGC 112. 806C-M0058-G03
L-Variable (AA):
(SEQ ID NO: 608)
QDIQMTQSPGTLSLSPGERATLSCRASQSVTSSFLSWYQHRPGQAPRLLI
YATSTRATGIPDRFSGSGSGTDFTLTISRLEPEDFAVYYCQHYHTSPPTY
TFGQGTKLEIK L-Variable (DNA):
(SEQ ID NO: 609)
CAAGACATCCAGATGACCCAGTCTCCAGGCACGCTGTCTTTGTCTCCAGG
GGAAAGAGCCACCCTCTCCTGCAGGGCCAGTCAAAGTGTGACCAGCAGCT
TCTTATCCTGGTACCAGCACAGACCTGGCCAGGCTCCCAGGCTCCTCATC
TATGCTACATCCACCAGGGCCACAGGCATCCCAGACAGGTTCAGTGGCAG
TGGGTCTGGGACAGACTTCACTCTCACTATCACCAGACTGGAGCCTGAAG
ATTTTGCAGTGTATTACTGTCAGCACTATCATACCTCACCTCCCACTTAC
ACTTTTGGCCAGGGGACCAAGCTGGAGATCAAA H-Variable (AA):
(SEQ ID NO: 610)
EVQLLESGGGLVQPGGSLRLSCAASGFTFSLYLMYWVRQAPGKGLEWVSV
IYPSGGWTYYADSVKGRFTISRDNSKNTLYLQNNSLRAEDTAMYYCARGY
YYGMDVWGQGTTVTVSS H-Variable (DNA):
(SEQ ID NO: 611)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCTTTACCTTA
TGTATTGGGTTCGCCAAGCTCCTGGTAAAGGTTTGGAGTGGGTTTCTGTT
ATCTATCCTTCTGGTGGCTGGACTTATTATGCTGACTCCGTTAAAGGTCG
CTTCACTATCTCTAGAGACAACTCTAAGAATACTCTCTACTTGCAGATGA
ACAGCTTAAGGGCTGAGGACACCGCCATGTATTACTGTGCGAGAGGCTAC
TACTACGGTATGGACGTCTGGGGCCAACGGACCACGGTCACCGTCTCAAG
C 113. 806C-M0058-H01
L-Variable (AA):
(SEQ ID NO: 612)
QSALTQPPSVSVAPGETAEITCGGENIGSKSVHWYQQKPGQAPVLVIYYD
NDRPSGIPERFSGSNFGSTATLTISRVEAGDEADYYCQVWDSGSEHYVFG
TETKVTVLGQ L-Variable (DNA):
(SEQ ID NO: 613)
CAGAGCGCTTTGACTCAGCCACCCTCAGTCTCAGTGGCCCCAGGGGAGAC
GGCCGAAATTACCTGTGGGGGCGAGAACATTGGAAGTAAAAGTGTCCATT
GGTACCAGCAGAAGCCAGGCCAGGCCCCCAGTGCTGGTCATCTATTATGAT
AACGACCGCCCCTCAGGGATCCCTGAGCGATTCTCTGGCTCCAACTTTGG
GAGCACGGCCACCCTGACCATCAGCAGGGTCGAAGCCGGGGATGAGGCCG
ACTATTACTGTCAGGTCTGCGATAGTGGCAGTGAGCACTATGTCTTCGGA
ACTGAGACCAAGGTCACCGTCCTAGGTCAG H-Variable (AA):
(SEQ ID NO: 614)
EVQLLESCGGLVQPGGSLRLSCAASCFTFSCYIMMWVRQAPGKGLEWVSS
IYPSGGHTYYADSVKGRFTISRDNSKNTLYLQMNSLRAEDTAVYYCARWY
YGNDVWGQGTTVTVSS H-Variable (DNA):
(SEQ ID NO: 615)
GAAGTTCAATTGTTAGAGTCTCGTGGCGCTCTTGTTCAGCCTGGTGCTTC
TTTACGTCTTTCTTGCGCTGCTTCCGGATTCACTTTCTCTGTTACATTA
TGATGTGGGTTCGCCAAGCTCCTGGTAAAGCTTTGGAGTGGGTTTCTTCT
ATCTATCCTTCTGGTGGCCATACTTATTATGCTCACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGATGGTAT
TACGGTATGGACGTCTGGGGCCAAGGGACCACGGTCACCGTCTCAAGC 114. 806C-M0059-A02
L-Variable (AA):
(SEQ ID NO: 616)
QSALTQPASVSGSPGQSITISCTGTNSDVGGYNYVSWYQQHPGKAPKLII
FDVTNRPSGVSNRFSGSKAGNTASLTISGLQAEDEADYYCSSYSSTSPRF
GGGTKLTVL L-Variable (DNA):
(SEQ ID NO: 617)
CAGAGCGCTTTGACTCAGCCTGCCTCCGTGTCAGGGTCTCCTGGACAGTC
GATCACCATTTCCTGCACTGGAACCAACAGTGACGTTGGTGGTTATAACT
ATGTCTCCTGGTACCAACAGCACCCAGGCAAAGCCCCCAAACTCATAATT
TTTGATGTCACTAATCGGCCCTCAGGGGTTTCTAATCGCTTCTCTGGCTC
CAAGGCTGGCAACACGGCCTCCCTGACCATCTCTGGGCTCCAGGCTGAGG
ACGAGGCTGATTATTACTGCAGCTCATATTCAAGTACCAGCCCTCGCTTC
GGCGGAGGGACCAAGCTGACCGTCCTG H-Variable (AA):
(SEQ ID NO: 618)
EVQLLESGGGLVQPGGSLRLSCAASGFTFSMYQMQWVRQAPGKGLEWVSR
IYPSGGWTVYADSVKGRFTISRDNSKNTLYLQMNSLRAEDTAVYYCTRIT
YDSSGYYDYWGQGTLVTVSS H-Variable (DNA):
(SEQ ID NO: 619)
GAAGTTCAATTGTTAGAGTCTGGTGGCGGTCTTGTTCAGCCTGGTGGTTC
TTTACGTCTTTCTTGCGCTGCTTCCGGATTCACTTTCTCTATGTACCAGA
TGCAGTGGGTTCGCCAAGCTCCTGGTAAAGGTTTGGAGTGGGTTTCTCGT
ATCTATCCTTCTGGTGGCTGCACTGTTTATGCTGACTCCGTTAAAGGTCG
CTTCACTATCTCTAGAGACAACTCTAAGAATACTCTCTACTTGCAGATGA 115. 806C-M0059-A06
L-Variable (AA):
(SEQ ID NO: 620)
QDIQMTQSPSSLSASVGDRVAITCRASQSIDTYLNWYQHKPGKAPKLLIY
AASKLEDGVPSRFSGSGTGTDFTLTIRSLQPEDFASYFCQQSYSSPGITF
GPGTKVEIK L-Variable (DNA):
(SEQ ID NO: 621)
CAAGACATCCAGATGACCCAGTCTCCATCCTCCCTGTCTGCATCTGTGGG
AGACACAGTCGCCATCACTTGCCGCGCAAGTCAGAGCATCGACACCTATT
TAAATTGGTATCAGCACAAACCAGGGAAAGCCCCTAAACTCCTGATCTAT
GCTGCATCCAAGTTGGAAGACGGGGTCCCATCAAGATTCAGTGGCAGTGG
AACTGGGACAGATTTCACTCTCACCATCAGAAGTCTGCAACCTGAAGATT
TTGCAAGTTATTTCTGTCAACAGAGCTACTCAGTCCAGGGATCACTTTC
GGCCCTGGGACCAAGGTGGAGATCAAA H-Variable (AA):
(SEQ ID NO: 622)
EVQLLESGGGLVQPGGSLRLSCAASGFTFSPYKMWVRQAPGKGLEWVSGI
YPSGGWTYYADSVKGRFTISRDNSKNTLYLQMNSLRAEDTAIMIYYCARL
LPALRGAVMDVWGQGTTVTVSS H-Variable (DNA):
(SEQ ID NO: 623)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCCTTACAAGA
TGATTTGGGTTCGCCAAGCTCCTGGTAAAGGTTTGGAGTGGGTTTCTGGT
ATCTATCCTTCTGGTGGCTGGACTTATTATGCTGACTCCGTTAAAGGTCG
CTTCACTATCTCTAGAGACAACTCTAAGAATACTCTACTTGCAGATGA
ACAGCTTAAGGGCTGAGGACACCGCCATGTATTACTGTGCGAGACTGTTA
CCAGCCTTGCGGGGAGCCGTGATGGACGTCTGGGGCCAAGGGACCACGGT
CACCGTCTCAAGC 116. 806C-M0060-B02
L-Variable (AA):
(SEQ ID NO: 624)
QSVLTQDPTVSVALGQTVRITCRGDRLRSYYSSWYQQKPRQAPVLVMFGR
NNRPSGIPDRFSGSTSGSTASLTITATQADDEADYFCSSRDGSGNFLFGG
GTKLTVL L-Variable (DNA):
(SEQ ID NO: 625)
CAGAGCGTCTTGACTCAGGACCCTACTGTGTCTGTGGCCTTGGGGCAGAC
AGTCAGGATCACATGCCGAGGAGACAGACTCAGAAGTTATTATTCAAGTT
GGTACCAGCAGAAGCCACGACAGGCCCCTGTTCTTGTCATGTTTGGTAGA
AACAACCGGCCCTCAGGGATCCCAGACCGATTCTCTGGCTCCACCTCAGG
AAGCACAGCTTCCTTCACCATCACTGCGACTCAGGCGGACGATGAGGCTG
ACTATTTCTGTAGTTCCCGGGACGGCAGTGGTAATTTCCTCTTCGGCGGA
GGGACCAAACTGACCGTCCTT H-Variable (AA):
(SEQ ID NO: 626)
EVQLLESGGGLVQPGGSLRLSCAASGFTFSIYPMHWVRQAPGKGLEWVSS
IYPSGGITRYADSVKGRFTISRDNSKNTLYLQMNSLRAEDTALYYCARQR
GSGWHDSWGQGTLVTVSS H-Variable (DNA):
(SEQ ID NO: 627)
GAAGTTCAATTGTTAGAGTCTGGTCGCGGTCTTCTTCAGCCTGGTGGTTC
TTTACGTCTTTCTTGCGCTGCTTCCGGATTCACTTTCTCTATTTACCCTA
TGCATTGGGTTCGCCAAGCTCCTGGTAAAGGTTTGGAGTGGGTTTCTTCT
ATCTATCCTTCTGGTGGCATTACTCGTTATGCTGACTCCGTTAAAGGTCG
CTTCACTATCTCTAGAGACAACTCTAAGAATACTCTACTTGCAGATGA
ACAGCTTAAGGGCTGAGGACACCGCCTTGTATTACTGTGCGAGACAACGG
GGCAGTGGCTGGCATCACTCCTGGGCCAGGGAACCCTGGTCACCGTCTC
AAGC 117. 806C-M0060-H01
L-Variable (AA):
(SEQ ID NO: 628)
QDIQMTQSPATLSLSPGERATLSCRASQSVSSYLAWYQQKPGQAPRLLIY
DASNRATGIPARFSGSGSGTDFTLTISSLEPEDFAVYYCQQRSNWPVTFG
QGTRLEIK L-Variable (DNA):
(SEQ ID NO: 629)
CAAGACATCCAGATGACCCAGTCTCCAGCCACCCTGTCTTTCTCTCCAGG
GGAAAGAGCCACCCTCTCCTGCAGGGCCAGTCAGAGTGTTAGCAGCTACT
TAGCCTGGTACCAACAGAAACCTGGCCAGGCTCCCAGGCTCCTCATCTAT
GATGCATCCAACAGGGCCACTGGCATCCCAGCCAGGTTCAGTGGCAGTGG
GTCTGGGACAGACTTCACTCTCACCATCAGCAGCCTAGAGCCTGAAGATT
TTGCAGTTTATTACTGTCAGCAGCGTAGCAACTGGCCGGTCACCTTCGGC
CAAGGGACACGACTGGAGATTAAA H-Variable (AA):
(SEQ ID NO: 630)
EVQLLESGGGLVQPGGSLRLSCAASGFTFSYYPMVWVRQAPGKGLEWVSV
IVPSGGFTAYADSVKGRFTISRDNSKNTLYLQMNSLRAEDTAMYYCARKR
PCNAFDIWGQGTMVTVSS H-Variable (DNA):
(SEQ ID NO: 631)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTATTACCCTA
TGGTTTGGGTTCGCCAAGCTCCTGGTAAAGGTTTGGAGTGGGTTTCTGTT
ATCGTTCCTTCTGGTGGCTTTACTGCTTATGCTGACTCCGTTAAAGGTCG
CTTCACTATCTCTAGAGACAACTCTAAGAATACTCTACTTGCAGATGA
ACAGCTTAAGGGCTGAGCACACCGCCATGTATTACTGTGCGAGAAAGCGA
CCTGGAAATGCTTTTGATATCTGGGGCCAAGGGACAATGGTCACCGTCTC
AAGC 118. 806C-M0061-A03
L-Variable (AA):
(SEQ ID NO: 632)
QDIQMTQSPSFLSASVGDSVAITCRASQDISRFLAWYQQRPGKAPKLLIF
SASTLQSGVPSRFSGSGSCTEFTLTINALQPEDFATYYCQQLSRYSTFGQ
GTKLEIK L-Variable (DNA):
(SEQ ID NO: 633)
CAAGACATCCAGATGACCCAGTCTCCATCCTTCCTGTCTGCATCTGTAGG
AGACAGTGTCGCCATCACTTGCCGCGCCAGTCAGGACATTAGTCGTTTTT
TAGCCTGGTATCAGCAAAGACCAGGGAAAGCCCCTAAACTCCTGATTTTT
TCTGCTTCCACTTTACAAAGTGGGGTCCCATCCAGGTTCAGCGGCAGTGG
ATCTGGGACAGAATTTACTCTCACAATCAACGCCCTGCAGCCTGAAGATT
TTGCAACTTATTACTGTCAACAACTTAGTCGTTATTCGACGTTCGGCCAA
GGCACCAAACTGCAAATCAAA H-Variable (AA):
(SEQ ID NO: 634)
EVQLLESGGGLVQPGGSLRLSCAASGFTFSYYKAMWWVRQAPGKGLEWVS
SISPGGWTHYADSVKGRFTISRDNSKNTLYLQMNSLRAEDTAVYYCARGP
VSSGGDYWGQGTLVTVSS H-Variable (DNA):
(SEQ ID NO: 635)
GAAGTTCAATTGTTAGAGTCTGGTGGCGGTCTTCTTCAGCCTGGTGGTTC
TTTACGTCTTTCTTGCGCTGCTTCCGGATTCACTTTCTCTTATTACAAGA
TGTGGTGGGTTCGCCAAGCTCCTGGTAAAGGTTTGGAGTGGGTTTCTTCT
ATCTCTCCTGGTGGCTGGACTCATTATGCTGACTCCGTTAAAGGTCGCTT
CACTATCTCTAGAGACAACTCTAAGAATACTCTACTTGCAGATGAACA
GCTTAAGGGCTGAGGACACGGCCGTGTATTACTGTGCTAGAGGCCCTGTC
AGTAGTGGTGGGGACTACTGGGGCCAGCGAACCCTGGTCACCGTCTCAAG
C 119. 806C-M0061-C05
L-Variable (AA):
(SEQ ID NO: 636)
QDIQMTQSPATLSLSPGERATLSCRASQSVSSYLAWYQQKPGQAPRLLIY
DASNRATGIPARFSGSGSGTDFTLTISSLEPEDFAVYYCQQRSNWPPLTF
GGGTKVEIK L-Variable (DNA):
(SEQ ID NO: 637)
CAAGACATCCAGATGACCCAGTCTCCAGCCACCCTGTCTTTGTCTCCAGG
GGAAAGAGCCACCCTCTCCTGCAGGGCCAGTCAGAGTGTTAGCAGCTACT
TAGCCTGGTACCAACAGAAACCTGGCCAGGCTCCCAGGCTCCTCATCTAT
GATGCATCCAACAGGGCCACTGGCATCCCAGCCAGGTTCAGTGGCAGTGG
GTCTGGGACAGACTTCACTCTCACCATCAGCAGCCTAGAGCCTGAAGATT
TTGCAGTTTATTACTGTCAGCAGCGTAGCAACTGGCCTCCGCTCACTTTC
GGCGGAGGGACCAAGGTGGAGATCAAA -continued H-Variable (AA):
(SEQ ID NO: 638)
EVQLLESGGGLVQPGGSLRLSCAASGFTFSQYVMMWVRQAPGKGLEWVSS
IYPSGGQTYYADSXTKGRETISRDNSKNTLYLQMNSLRAEDTAVYYCAKI
ACGAYHLDYWGQGTLVTVSS H-Variable (DNA):
(SEQ ID NO: 639)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCAGTACGTTA
TGATGTGGGTTCGCCAAGCTCCTGGTAAAGGTTTGGAGTGGGTTTCTTCT
ATCTATCCTTCTGGTGGCCAGACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGCCGTGTATTACTGTGCGAAAATTGCA
GGGGGAGCCTACCACCTTGATTACTGGGGCCAGGGAACCCTGGTCACCGT
CTCAAGC 120. 806C-M0061-C06
L-Variable (AA):
(SEQ ID NO: 640)
QYELTQPASVSGSPGQSITISCTGTSSDVGGYNYVSWYQQHPGKAPKLTI
FDVTKRPSGVSDRFSGSKSDNTASLTISGLQAEDEADYYCGSYTSSGSRV
FGTGTKVTVL L-Variable (DNA):
(SEQ ID NO: 641)
CAGTACGAATTGACTCAGCCTGCCTCCGTGTCTGGGTCTCCTGGACAGTC
GATCACCATCTCCTGCACTGGAACCAGCAGTGACGTTGGTGGTTATAACT
ATGTCTCCTGGTACCAACAACACCCAGGCAAAGCCCCCAAACTCACGATT
TTTGATGTCACTAAACGGCCCTCCCTCACCATCTCTGGGCTCCAGGCTGAAG
ACGAAGCTGATTATTACTGCGGCTCATATACAAGCAGCGGCTCTCGGGTC
TTCGGAACTGGGACCAAGGTCACCGTCCTC H-Variable (AA):
(SEQ ID NO: 642)
EVQLLESGGGLVQPGGSLRLSCAASGFTFSRYVMGWVRQAPGKGLEWVSR
IYPSGGFTYYADSVKGRFTISRDNSKNTLYLQMNSLRAEDTAVYYCTRIR
EGYFDYWGQGTLVTVSS H-Variable (DNA):
(SEQ ID NO: 643)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACGTTA
TGGGTTGGGTTCGCCAAGCTCCTGGTAAAGGTTTGGAGTGGGTTTCTCGT
ATCTATCCTTCTGGTGGCTTTACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTACGAGGATAAGG
GAAGGGTACTTTGACTACTGGGGCCAGGGAACCCTGGTCACCGTCTCAAG
C 121. 806C-M0061-F07
L-Variable (AA):
(SEQ ID NO: 644)
QDIQMTQSPSSLSASVGDRVAITCRASQSIDTYLNWYQQKPGKAPKLLIY
AASKLEDGVPSRFSGSGTGTDFTLTIRSLQPEDFASYFCQQSYSSPGITF
GPGTKVEIK L-Variable (DNA):
(SEQ ID NO: 645)
CAAGACATCCAGATGACCCAGTCTCCATCCTCCCTGTCTGCATCTGTGGG
AGACAGAGTCGCCATCACTTGCCGCGCAAGTCAGAGCATCGACACCTATT
TAAATTGGTATCAGCAGAAACCAGGGAAAGCCCCTAAACTCCTGATCTAT
GCTGCATCCAAGTTGGAAGACGGGGTCCCATCAAGATTCAGTGGCAGTGG
AACTGGGACAGATTTCACTCTCACCATCAGAAGTCTGCAACCTGAAGATT
TTGCAAGTTATTTCTGTCAACAGAGCTACTCTAGTCCAGGGATCACTTTC
GGCCCTGGGACCAAGGTGGAGATCAAA H-Variable (AA):
(SEQ ID NO: 646)
EVQLLESGGGLVQPGGSLRLSCAASGFTFSHYVNTWVRQAPGKGLEWVSS
IYPSGGFTAYADSVTGRFTISRDNSKNTLYLQMNSLRAEDTAMYYCAKST
YYYEGSGYYRAFDIWCQGTMVTVSS H-Variable (DNA):
(SEQ ID NO: 647)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCATTACGTTA
TGACTTGGGTTCGCCAAGCTCCTGGTAAAGGTTTGGAGTGGGTTTCTTCT
ATCTATCCTTCTGGTGGCTTTACTGCTTATGCTGACTCCGTTACAGGTCG
CTTCACTATCTCTAGACACAACTCTAAGAATACTCTCTACTTGCAGATGA
ACAGCTTAAGGGCTGAGGACACCGCCATGTATTACTGTGCGAAATCGACT
TATTACTATGAGGGTAGTGGTTATACCGCGCTTTTGATATCTGGGGCCA
AGGGACAATGGTCACCGTCTCAAGC 122. 806C-M0061-G12
L-Variable (AA):
(SEQ ID NO: 648)
QDIQMTQSPATLSLSPGERATLSCRASQSVSSSYLAWYQQKPGQAPRLLI
YGASNRATGIPARFSGSGSGTDFTLTISGLEPEDFVVYYCQKYGSSSLTF
GGGTKVEIK L-Variable (DNA):
(SEQ ID NO: 649)
CAAGACATCCAGATGACCCAGTCTCCAGCCACCCTGTCTCTATCTCCAGG
GGAAAGAGCCACCCTCTCCTGCAGGGCCAGTCAGAGTGTTAGCAGCAGCT
ACTTAGCCTGGTACCAGCAGAAACCTGGCCAGCCTCCCAGGCTCCTCATC
TATGGTGCATCCAACAGGGCCACTGGCATCCCAGCCAGGTTCAGTGGCAG
TGGGTCTGGGACAGACTTCACTCTCACCATCAGTGGCCTGGAGCCTGAAG
ATTTTGTACTGTATTACTGTCAGAAGTATGGTAGTTCATCGCTCACTTTC
GGCGGAGGGACCAAGGTGGAGATCAAA H-Variable (AA):
(SEQ ID NO: 650)
EVQLLESGGGLVQPGGSLRLSCAASGFTFSQYKNWWVRQAPGKGLEWVSV
IYPSGGVTYYADSVKGRFTISRDNSKNTLYLQMNSLEAEDTAVYYCAISY
SPVGAFDIWGQGTNVTVSS H-Variable (DNA):
(SEQ ID NO: 651)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCAGTACAAGA
TGTGGTGGGTTCGCCAAGCTCCTGGTAAAGGTTTGGAGTGGGTTTCTGTT
ATCTATCCTTCTGGTGGCGTTACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGCCGTGTATTACTGTGCGATCTCGTAT
AGTCCCGTGGGGGCTTTTGATATCTGGGGCCAAGGGACAATGGTCACCGT
CTCAAGC 123. 806C-M0061-H09
L-Variable (AA):
(SEQ ID NO: 652)
QSALTQPPSVSGSPGQSVTISCTGTSSDVGSYNRVSWYRQPPGTAPKVII
YDINNRPSGVPDRFSGSRSGDTAYLTISGLQVEDEADYYCSSFTSSSTYI
FGTGTKVTVL L-Variable (DNA):
(SEQ ID NO: 653)
CAGAGCGCTTTGACTCAGCCTCCCTCCGTGTCCGGGTCTCCTGGACAGTC
AGTCACCATTTCCTGCACTGGAACCAGCAGTGACGTTGCTAGTTATAACC
GTGTCTCCTGGTACCGGCAGCCCCCAGGCACAGCCCCCAAAGTCATCATT
TATGACATCAATAATCGCCCTCAGGTGTCCCTCATCGCTTCTCTGGGTC
CAGGTCTGGCGACACGGCCTACCTGACCATCTCTGGGCTCCAGGTGGAGG
ACGAGGCTGATTATTACTGTAGCTCATTTACAAGCAGCACCACCTATATC
TTCGGAACTGGGACCAAGGTCACCGTCCTG H-Variable (AA):
(SEQ ID NO: 654)
EVQLLESGGGLVQPGGSLRLSCAASGFTFSVYKNYWVRQAPGKGLEWVSV
IYPSGGYTDYADSVKGRFTISRDNSKNTLYLQMNSLTAEDTAVYYCARQL
PMSYFDYWGQGTLVTVSS H-Variable (DNA):
(SEQ ID NO: 655)
GAAGTTCAATTGTTAGACTCTGGTGGCGGTCTTGTTCAGCCTGGTGGTTC
TTTACGTCTTTCTTGCGCTGCTTCCGGATTCACTTTCTCTGTTTACAAGA
TGTATTGGCTTCGCCAAGCTCCTGGTAAAGGTTTGGAGTGGGTTTCTGTT
ATCTATCCTTCTGGTGGCTATACTGATTATGCTGACTCCGTTAAAGGTCG
CTTCACTATCTCTAGAGACAACTCTAAGAATACTCTCTACTTGCAGATGA
ACAGCTTAAGGGCTGAGGACACGCCGTGTATTACTGTGCGCGGCAGCTG
CCCATGTCGTACTTTGACTACTGGGGCCAGGGAACCCTGGTCACCGTCTC
AAGC 124. 806C-M0062-A12
L-Variable (AA):
(SEQ ID NO: 656)
QDIQMTQSPLSLPVTPGEPASMSCRSSQSLLQSNGYNYLDWYLQKPGQSP
QLLIYLGSNRASGVPDRFSGSGSGTDFTLKISRVEAEDVGVYYCMQALQT
WTFGQGTKVEIK -continued L-Variable (DNA):
(SEQ ID NO: 657)
CAAGACATCCAGATGACCCAGTCTCCACTCTCCCTGCCCGTCACCCCTGG
AGAGCCGGCCTCCATGCCTGCAGGTCTAGTCAGAGCCTCCTGCAAAGTA
ATGGATACAACTATTTGGATTGGTACCTGCAGAAGCCAGGGCAGTCTCCA
CAGCTCCTGATCTATTTGGGTTCTAATCGGGCCTCCGGGGTCCCTGACAG
GTTCAGTGGCAGTGGATCAGGCACAGATTTTACACTGAAAATCAGCAGAG
TGGAGGCTGAGGATGTTGGGGTTTATTACTGCATGCAAGCTCTACAAACT
TGGACGTTCGGCCAAGGGACCAAGGTGGAAATCAAA H-Variable (AA):
(SEQ ID NO: 658)
EVQLLESGGGLVQPGGSLRLSCAASGFTFSRYVMVWVRQAPGKGLEWVSR
IYPSGGFTNYADSVKGRFTISRDNSKNTLYLQMNSLRAEDTAVYYCARDK
TAHMDVGKGTTVTSS H-Variable (DNA):
(SEQ ID NO: 659)
GAAGTTCAATTGTTAGACTCTGGTGGCGGTCTTGTTCAGCCTGGTGGTTC
TTTACGTCTTTCTTGCGCTGCTTCCGGATTCACTTTCTCTCGTTACGTTA
TGGTTTGGGTTCGCCAAGCTCCTGGTAAAGGTTTGGAGTGGGTTTCGCGT
ATCTATCCTTCTGGTGGCTTTACTAATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGATAAG
ACAGCCCACATGGACGTCTGGGCAAAGGGACCACGGTCACCGTCTCAAG
C 125. 806C-M0062-B05
L-Variable (AA):
(SEQ ID NO: 660)
QDIQMTQSPATLSLSPGERATLSCRASQSVSSYLAWYQQKPGQAPRLLIY
DASNRATGIPARFSGSGSGTDFTLTISSLEPEDFAVYYCQQRSSWPPLTF
GGGTKVEIK L-Variable (DNA):
(SEQ ID NO: 661)
CAAGACATCCAGATCACCCAGTCTCCAGCCACCCTGTCTTTGTCTCCAGG
GGAAAGAGCCACCCTCTCCTGCACGGCCAGTCAGAGTGTTAGCAGCTACT
TAGCCTGCTACCAACAGAAACCTGGCCAGCCTCCCACGCTCCTCATCTAT
GATGCATCCAACAGGGCCACTGGCATCCCAGCCAGGTTCAGTGGCAGTGG
GTCTGGGACAGACTTCACTCTCACCATCAGCAGCCTAGACCCTGAAGATT
TTGCAGTTTATTACTGTCAGCAGCGTAGCAGCTGGCCTCCGCTCACTTTC
GGCGGAGGGACCAAGGTGGAGATCAAG H-Variable (AA):
(SEQ ID NO: 662)
EVQLLESGGGLVQPGGSLRLSCAASGFTFSRYKNNWVRQAPGKGLEWVSS
IYPSGGWTNYADSVKGRFTISRDNSKNTLYLQMNSLRAEDTAVYYCARGG
RYGDYVRHWGQGTLVTVSS H-Variable (DNA):
(SEQ ID NO: 663)
GAAGTTCAATTGTTAGAGTCTGGTGGCGCTCTTGTTCAGCCTGGTGGTTC
TTTACGTCTTTCTTGCGCTGCTTCCGGATTCACTTTCTCTCGTTACAAGA
TGAATTGGGTTCGCCAAGCTCCTGGTAAAGGTTTGGAGTGGGTTTCTTCT
ATCTATCCTTCTGGTGGCTGGACTAATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCCAGAGGGGGG
AGATACGGTGACTACGTGCGTCACTGGGGCCAGGGAACCCTGGTCACCGT
CTCAAGC 126. 806C-M0062-B07
L-Variable (AA):
(SEQ ID NO: 664)
QDIQMTQSPATLSVSPGERATLSCRASQSVSSNLAWYQHKPGQAPRLLIY
GASIRATGIPARFSGSGSGTEFTLTISSLQSEDFGVYYCQQYKDWPRTFG
QGTKVEIK L-Variable (DNA):
(SEQ ID NO: 665)
CAAGACATCCAGATGACCCAGTCTCCAGCCACCCTGTCTGTGTCTCCAGG
GGAAAGAGCCACTCTCCTGCAGGGCCAGTCAGAGTGTTAGCAGCAACTT
AGCCTGGTACCAGCACAAACCTGGCCAGGCTCCCAGGCTCCTCATCTAT
GGTGCATCCATCAGGGCCACTGGTATCCCAGCCAGGTTCAGTGGCAGTGG
GTCTGGGACAGAGTTCACTCTCACCATCAGCAGCCTGCAGTCTGAAGATT
TTGGAGTTTATTATTGTCAGCAGTATAAGGACTGGCCTCGAACGTTCGGC
CAAGGGACCAAGGTGGAAATCAAA H-Variable (AA):
(SEQ ID NO: 666)
EVQLLESGGGLVQPGGSLRLSCAASGFTFSRYRITAWVRQAPCKGLEWVS
SIYPSGGVTYYADSVKGRFTISRDNSKNTLYLQMNSLRAEDTAVYYCARD
LSIAAAGTAYWGQGTLVTVSS H-Variable (DNA):
(SEQ ID NO: 667)
GAAGTTCAATTGTTAGAGTCTGGTGGCGGTCTTGTTCAGCCTGGTGGTTC
TTTACGTCTTTCTTCCGCTGCTTCCGGATTCACTTTCTCTCGTTACCGTA
TGGCTTGGGTTCGCCAAGCTCCTGGTAAAGGTTTGGAGTGGGTTTCTTCT
ATCTATCCTTCTGGTGCCGTTACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCAAGAGATCTT
AGTATAGCACCAGCTGGTACTGCCTACTGGGGCCAGGGAACCCTGGTCAC
CGTCTCAAGC 127. 806C-M0062-C08
L-Variable (AA):
(SEQ ID NO: 668)
QDIQMTQSPGTLSLSPGERATLSCRASQSFVGSRNLAWYQQKPGQPPRLL
IYGAFNRATGIPGRFSGSGSGTDFTLTISRLEPEDFAVYYCQQYGTSPRT
FCGGTKVEIK L-Variable (DNA):
(SEQ ID NO: 669)
CAAGACATCCACATGACCCAGTCTCCAGGCACGCTGTCTTTGTCTCCAGG
GGAAAGAGCCACCCTCTCCTGCAGGGCCAGTCAGAGTTTTGTCGGCAGCA
GAAACTTAGCCTGGTACCAGCAAAAACCTGGCCAGCCTCCCAGGCTCCTC
ATCTATGGTGCATTCAACAGGGCCACTGGCATCCCAGGCAGGTTTAGTGG
CAGTGGCTCTGCGACAGACTTCACTCTCACCATCAGCAGACTGGAGCCTG
AAGATTTTGCAGTGTATTACTGTCAGCAGTATGGTACCTCACCTCGCACT
TTCGGCGGAGGGACCAAAGTGGAGATCAAA H-Variable (AA):
(SEQ ID NO: 670)
EVQLLESGGGLVQPGGSLRLSCAASGFTFSRYVMQWVRQAPGKGLEWFSS
IYPSGGATIYADSVKGRFTISRDNSKNTLYLQMNSLRAEDTAVYYCARRG
IPGYFDSWGQGTLVTVSS H-Variable (DNA):
(SEQ ID NO: 671)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACGTTA
TGCAGTGGGTTCGCCAAGCTCCTGGTAAAGGTTTGGAGTGGTTTCTTCT
ATCTATCCTTCTGGTGGCTACTATTTATGCTGACTCCGTTAAAGGTCG
CTTCACTATCTCTAGACACAACTCTAAGAATACTCTCTACTTGCAGATGA
ACAGCTTAAGGGCTGAGGACACGGCCGTGTATTACTGTGCGAGAAGGGGA
ATTCCGGGCTACTTTGACTCCTGGGCGCCAGGGAACCCTGGTCACCGTCTC
AAGC 128. 806C-M0062-D04
L-Variable (AA):
(SEQ ID NO: 672)
QDIQMTQSPLSLSASIGDRVTITCRASQSISTYLNWYQQKPGKAPKLLTY
ATSTLQSGVPSRFSGSGSGTEFILTISGLQPEDFATYYCQQFNFYPLTLG
GGTRVEIKRT L-Variable (DNA):
(SEQ ID NO: 673)
CAAGACATCCAGATCACCCAGTCTCCACTCTCCCTGTCTGCATCTATAGG
AGACAGAGTCACCATCACTTGCCGGGCAAGTCAGAGCATTAGCACCTATT
TAAATTGGTATCAGCAGAAGCCAGGGAAAGCCCCTAAACTCCTGATCTAT
GCAACTTCCACTTTACAGAGTGGGGTCCCATCAAGGTTCAGCGGCAGTGG
ATCTGGGACAGAATTCATTCTCACAATCAGCGGCCTGCACCCTGAAGATT
TTGCAACTTATTACTGTCAACAGTTTAATTTTTATCCTCTCACTCTCGGC
GGAGGGACCAGGGTGGAGATCAAACGAACT H-Variable (AA):
(SEQ ID NO: 674)
EVQLLESGGGLVQPGGSLRLSCAASGFTFSSYGMVWVRQAPGKGLEWVSS
ISPSGGNTGYADSVKGRFTISRDNSKNTLYLQITNSLRAEDTAVYYCARG
NGGFDSWGQGTLVTVSS H-Variable (DNA):
(SEQ ID NO: 675)
GAAGTTCAATTGTTAGAGTCTGGTGGCGGTCTTGTTCAGCCTGGTGGTTC
TTTACGTCTTTCTTGCGCTGCTTCCGGATTCACTTTCTCTTCTTACGGTA
TGGTTTGGGTTCGCCAAGCTCCTGGTAAAGGTTTGGAGTGGGTTTCTTCT
ATCTCTCCTTCTGGTGGCAATACTGGTTATGCTGACTCCGTTAAAGGTCG

129. 806C-M0062-E02
L-Variable (AA):
(SEQ ID NO: 676)
QSVLTQPASVSGSPGQSITISCTGTSSDVGSYNLVSWYQQHPGKAPKLMI
YEGSKRPSGVSNRFSGSKSGNTASLTISGLQAEDEADYYCCSYAGSSTYV
FGTGTKVTVL L-Variable (DNA):
(SEQ ID NO: 677)
CAGAGCGTCTTGACTCAGCCTGCCTCCGTGTCTGGGTCTCCTGGACAGTC
GATCACCATCTCCTGCACTGGAACCAGCAGTGATGTTGGGAGTTATAACC
TTGTCTCCTGGTACCAACAGCACCCAGGCAAAGCCCCCAAACTCATGATT
TATGAGGGCAGTAAGCGGCCCTCAGGGGTTTCTAATCGCTTCTCTGGCTC
CAAGTCTGGCAACACGGCCTCCCTGACAATCTCTGGGCTCCAGGCTGAGG
ACGAGGCTGATTATTACTGCTGCTCATATGCAGGTAGTAGCACTTATGTC
TTCGGAACTGGGACCAAGGTCACCGTCCTA H-Variable (AA):
(SEQ ID NO: 678)
EVQLLESGGGLVQPGGSLRLSCAASGFTFSHYVMSWVRQAPGKGLEWVSV
IYPSGGWTGYADSVKGRFTISRDNSKNTLYLQMNSLRAEDTAVYYCARGV
ATTSFDYWGQGTLVTVSS H-Variable (DNA):
(SEQ ID NO: 679)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCATTACGTTA
TGTCTTGGGTTCGCCAAGCTCCTGGTAAAGGTTTGGAGTGGGTTTCTGTT
ATCTATCCTTCTGGTGGCTGGACTGGTTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGGGGTG
GCAACTACTAGTTTTGACTACTGGGGCCAGGGAACCCTGGTCACCGTCTC
AAGC

130. 806C-M0062-E03
L-Variable (AA):
(SEQ ID NO: 680)
QDIQMTQSPATLSLSPGERATLSCRASQSVSSYLAWYQQKPGQAPRLLIY
DASNRATGIPARFSGSGSGTDFTLTISSLEPEDFAVYYCQQRSNWPRSIT
FGQGTRLEIK L-Variable (DNA):
(SEQ ID NO: 681)
CAAGACATCCAGATGACCCAGTCTCCAGCCACCCTGTCTTTGTCTCCAGG
GGAAAGAGCCACCCTCTCCTGCAGGGCCAGTCAGAGTGTTAGCAGCTACT
TAGCCTGGTACCAACAGAAACCTGGCCAGGCTCCCAGGCTCCTCATCTAT
GATGCATCCAACAGGGCCACTGGCATCCCAGCCAGGTTCAGTGGCAGTGG
GTCTGGGACAGACTTCACTCTCACCATCAGCAGCCTAGAGCCTGAAGATT
TTGCAGTTTATTACTGTCAGCAGCGTAGCAACTGGCCTCGATCGATCACC
TTCGGCCAAGGGACACGACTGGAGATTAAA H-Variable (AA):
(SEQ ID NO: 682)
EVQLLESCGGLVQPGGSLRLSCAASGFTFSRYLNRWVRQAPGKGLEWVSG
IYPSGGTTAYADSVKGRETISRDNSKNTLYLQMNSLRAEDTAVYYCARAS
GSYYNYYFDYWGQGTLVTVSS H-Variable (DNA):
(SEQ ID NO: 683)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACCTTA
TGCGTTGGGTTCGCCAAGCTCCTGGTAAAGGTTTGGAGTGGGTTTCTGGT
ATCTATCCTTCTGGTGGCATTACTGCTTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGCTTCG
GGGAGTTATTATAATTACTACTTTGACTACTGGGGCCAGGGCACCCTGGT
CACCGTCTCAAGC

131. 806C-M0062-E11
L-Variable (AA):
(SEQ ID NO: 684)
QDIQMTQSPSSLSASVGDRVAITCRASQSIDTYLNWYQHKPGKAPKLLIY
AASKLEDGVPSRFSGSGTGTDFTLTIRSLQPEDFASYFCQQSYSSPGITF
GPGTKVEIK L-Variable (DNA):
(SEQ ID NO: 685)
CAAGACATCCAGATGACCCAGTCTCCATCCTCCCTGTCTGCATCTGTGGG
AGACAGAGTCGCCATCACTTGCCGCGCAAGTCAGAGCATCGACACCTATT
TAAATTGGTATCAGCACAAACCAGGGAAAGCCCCTAAACTCCTGATCTAT
GCTGCATCCAAGTTGGAAGACGGGGTCCCATCAAGATTCAGTGGCAGTGG
AACTGGGACAGATTTCACTCTCACCATCAGAGTCTGCAACCTGAAGATTT
TGCAAGTTATTTCTGTCAACAGAGCTACTCTAGTCCAGGGATCACTTTCG
GCCCTGGCACCAAGGTGGAGATCAAA H-Variable (AA):
(SEQ ID NO: 686)
EVQLLESGGGLVQPGGSLRLSCAASGFTFSAYVMHWVRQAPGKGLEWVSR
IYPSGGITYYADSVKGRFTISRDNSKNTLYLQMNSLRAEDTAVYYCARGI
LTGPNYWGQGTLVTVSS H-Variable (DNA):
(SEQ ID NO: 687)
GAAGTTCAATTGTTAGAGTCTGGTGGCGGTCTTGTTCAGCCTGGTGGTTC
TTTACGTCTTTCTTGCGCTGCTTCCGGATTCACTTTCTCTGCTTACGTTA
TGCATTGGGTTCGCCAAGCTCCTGGTAAAGGTTTGGAGTGGGTTTCTCGT
ATCTATCCTTCTGGTGGCATTACTTATTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGGGATT
TTGACTGGCCCAAACTACTGGGGCCAGGGAACCCTGGTCACCGTCTCAAG
C

132. 806C-M0062-F10
L-Variable (AA):
(SEQ ID NO: 688)
QSALTQSPSASASLGASVKLTCSLSSGHSSYAIAWHQQQPEKGPQYLMKV
NSDGSHTKGDGIPDRFSGSSSGAERYLTTSSLQSEDEADYYCQTWGTGSW
VFGGGTKLTVL L-Variable (DNA):
(SEQ ID NO: 689)
CAGAGCGCTTTGACTCAATCGCCCTCTGCCTCTGCCTCCCTGGGAGCCTC
GGTCAAGCTCACCTGCAGTCTGAGCAGTGGGCACAGCAGCTACGCCATCG
CATGGCATCAGCAGCAGCCAGAGAAGGGCCCCCAGTACTTAATGAAGGTT
AACAGTGATGGCAGCCACACCAAGGGGGACGGCATCCCTGATCGCTTCTC
AGGCTCCAGCTCTGGGGCTGAGCGCTACCTCACCATCTCCAGCCTCCAGT
CTGAGGATGAGGCTGACTATTACTGTCAGACCTGGGGCACTGGCTCTTGG
GTGTTCGGCGGAGGGACCAAGCTGACCGTCCTA H-Variable (AA):
(SEQ ID NO: 690)
EVQLLESGGGLVQPGGSLRLSCAASGFTFSRYKMSWVRQAPGKGLEWVSY
IYPSGGHTEYADSVKGRFTISRDNSKNTLYLQMNSLRAEDTAVYYCARER
EGTPDYWGQGTLVTVSS H-Variable (DNA):
(SEQ ID NO: 691)
GAAGTTCAATTGTTAGAGTCTGGTGGCGGTCTTGTTCAGCCTGGTGGTTC
TTTACGTCTTTCTTGCGCTGCTTCCGGATTCACTTTCTCTCGTTACAAGA
TGTCTTGGGTTCGCCAAGCTCCTGGTAAAGGTTTGGAGTGGGTTTCTTAT
ATCTATCCTTCTGGTGGCCATACTGAGTATGCTGACTCCGTTAAAGGTCG
CTTCACTATCTCTAGAGACAACTCTAAGAATACTCTCTACTTGCAGATGA
ACAGCTTAAGGGCTGAGGACACGGCCGTGTATTACTGTGCGAGAGAAAGG
GAAGGGACCCCTGACTACTGGGGCCAGGGAACCCTGGTCACCGTCTCAAG
C

133. 806C-M0062-G06
L-Variable (AA):
(SEQ ID NO: 692)
QSVLTQPASVSGSPGQSITTSCTGTSSDDVGGYNYVSWYQQHPGKAPKLL
IYDVINRPSGVSNRFSGSKSGNTASLTISGLQAEDEADYYCSSYASSGAR
VFGTGTKVTVL L-Variable (DNA):
(SEQ ID NO: 693)
CAGAGCGTCTTGACTCAGCCTGCCTCCGTGTCTGGGTCTCCTGGACAGTC
GATCACCATCTCCTGCACTGGAACCAGCAGTGACGACGTTGGTGGTTATA
ACTATGTCTCCTGGTACCAACAACACCCAGGCAAAGCCCCCAAACTCCTG
ATTTATGATGTCATTAATCGGCCCTCAGGAGTTTCTAATCGCTTCTCTGG
GTCCAAGTCTGGCAACACGGCCTCCCTGACCATCTCTGGGCTCCAGGCTG
AGGACGAGGCTGATTATTACTGCAGCTCATATGCAAGCAGCGGCGCTCGA
GTCTTCGGAACTGGGACCAAGGTCACCGTCCTA -continued H-Variable (AA):
(SEQ ID NO: 694)
EVQLLESGGGLVQPGGSLRLSCAASGFTFSIYPNIWVRQAPGKGLEWVSV
IYPSGGHTRYADSVKGRFTISRDNSKNTLYLQMNSLRAEDTAVYYCTRRV
YSSGSAYFDLWGRCTLVTSS H-Variable (DNA):
(SEQ ID NO: 695)
GAAGTTCAATTGTTAGAGTCTGGTGGCGGTCTTGTTCAGCCTGGTGGTTC
TTTACGTCTTTCTTGCGCTGCTTCCGGATTCACTTTCTCTATTTACCCTA
TGATTTGGGTTCGCCAAGCTCCTGGTAAAGGTTTGGAGTGGGTTTCTGTT
ATCTATCCTTCTGGTGGCCATACTCGTTATGCTGACTCCGTTAAAGGTCG
CTTCACTATCTCTAGAGACAACTCTAAGAATACTCTACTTGCAGATGA
ACAGCTTAAGGGCTGAGGACACAGCCGTGTATTACTGTACGAGACGGGTA
TATAGTAGTGGTTCTGCGTACTTCGATCTCTGGGGCCGTGGCACCCTGGT
CACCGTCTCAAGC 134. 806C-M0062-H01
L-Variable (AA):
(SEQ ID NO: 696)
QDIQMTQSPSTLSASVGDRVTITCRASQSVAGLLAWFQQKPGKAPKLLIS
KASILETGVPSRFSGSGSGTEFTLTITSLQPDDFATYYCQQYSFNSGTFG
QGTRVEMX L-Variable (DNA):
(SEQ ID NO: 697)
CAAGACATCCAGATGACCCAGTCTCCTTCCACCCTGTCTGCATCTGTGGG
AGACACAGTCACCATCACCTGCCGGGCCAGCCAGAGTGTTGCTGGCTTGT
TGGCCTGGTTTCAGCAGAAACGGGCAAAGCCCCTAAACTCCTCATCTCT AAGGCGTCTATTTTAGAGACTGGGGTCCCATCAAGGTTCAGCGGCAGTGG
ATCTGGGACAGAATTCACTCTCACCATCACCAGCCTGCAGCCTGATGATT
TCGCAACTTATTACTGCCAACAATATAGTTTCAATTCTGGGACATTCGGC
CAAGGGACCAGGGTGGAAATGAAA H-Variable (AA):
(SEQ ID NO: 698)
EVQLLESGGGLVQPGGSLRLSCAASGFTFSMYKMAWVRQAPCKGLEWVSY
IYPSGGYTYYADSVKGRFTISRDNSKNTLYLQMNSLRAEDTALYYCARVR
DSAFDIWGQGTNVTVSS H-Variable (DNA):
(SEQ ID NO: 699)
GAAGTTCAATTGTTAGAGTCTGGTGGCGGTCTTGTTCAGCCTGGTGGTTC
TTTACGTCTTTCTTGCGCTGCTTCCGGATTCACTTTCTCTATGTACAAGA
TGGCTTGGGTTCGCCAAGCTCCTGGTAAAGGTTTGGAGTGGGTTTCTTAT
ATCTATCCTTCTGGTGGCTATACTTATTATGCTGACTCCGTTAAAGGTCG
CTTCACTATCTCTAGAGACAACTCTAAGAATACTCTACTTGCAGATGA
ACAGCTTAAGGGCTGAGGACACCGCCTTGTATTACTGTGCCAGAGTAAGG
GATTCCGCTTTTGATATCTGGGGCCAAGGGACAATGGTCACCGTCTCAAG
C Example 32

Exemplary Tie-1 Binding Sequences

Tables 5 and 6 list CDR regions of exemplary light and heavy chain variable regions which are listed herein.

TABLE 5

Heavy Chain Sequences

| Clone | HV-CDR1 | HV-CDR2 | HV-CDR3 |
|---|---|---|---|
| 806C-M0044-A06 | SYVMM | RIYPSGGITQYADSVKG | DVYRAFDI |
| 806C-M0044-A11 | SYKMH | SIYPSGGYTYYADSVKG | DSHHFHFWGDYYFLEY |
| 806C-M0044-B04 | QYLMF | YIYPSGGWTMYADSVKG | QNYYDSSGYYYRGFDY |
| 806C-M0044-B05 | SYKMG | SIYPSGGWTHYADSVKG | VLLHYFDY |
| 806C-M0044-B08 | AYGMG | VISPSGGQTSYADSVKG | GDRYGPLHY |
| 806C-M0044-B09 | NYKMN | VIYPSGGWTYYADSVKG | GYYDSSGYSRFDY |
| 806C-M0044-B10 | RYKMG | SIYPSGGPTYYADSVKG | SEVGAPDY |
| 806C-M0044-B12 | MYKMH | SIYPSGGYTVYADSVKG | DRWSSGYGVDF |
| 806C-M0044-C07 | HYDMS | YIYPSGGPTYYADSVKG | GDWASRFAT |
| 806C-M0044-D01 | HYKMG | SIYPSGGFTRYADSVKG | NFVESSHYYHDY |
| 806C-M0044-E03 | RYVMF | GIYPSGGHTRYADSVKG | RGSGGYFDY |
| 806C-M0044-F03 | RYKMI | SIYPSGGTTSYADSVKG | SDLGSGWYSAEYFQH |
| 806C-M0044-F06 | SYLMI | RIYPSGGGTEYADSVKG | VTYYYDSSGYQPAFDI |
| 806C-M0044-F09 | HYGMT | VIGPSGGNTMYADSVKG | VWGAFDI |
| 806C-M0044-G06 | SYKMG | SIYPSGGWTHYADSVKG | VLLHYFDY |
| 806C-M0044-G07 | SYKMG | SIYPSGGWTHYADSVKG | VLLHYFDY |
| 806C-M0044-C11 | AYPML | SISPSGGATAYADSVKG | GSYSDYGVFES |
| 806C-M0044-H03 | RYRMS | GIVPSGGWTTYADSVKG | DNYYDFWSGYYISRFGMDV |
| 806C-M0044-H05 | SYMMF | RIYPSGGWTYYADSVKG | VTVPLDSGSYYFDY |
| 806C-M0044-H07 | SYLMT | SIYPSGGWTYYADSVKG | EMYYDFWSGYYRGFDI |
| 806C-M0044-H09 | WYGMN | SISPSGGQTPYADSVKG | DLGGAYIPDS |

TABLE 5-continued

Heavy Chain Sequences

| Clone | HV-CDR1 | HV-CDR2 | HV-CDR3 |
|---|---|---|---|
| 806C-M0045-A02 | TYPMM | VISPSGGQTSYADSVKG | GGRLNAFDI |
| 806C-M0045-A04 | IYQMG | RIYPSGGVTKYADSVKG | DFGPGDLWSGYYDAFDI |
| 806C-M0045-B01 | SYQMQ | VIYPGGYTYYADSVKG | LQFYGSSAAFDI |
| 806C-M0045-B03 | QYPMI | VISPSGGHTSYADSVKG | IQYYGGAFDI |
| 806C-M0045-B11 | PYGML | VISPSGGQTFYADSVKG | LGAEKGMDV |
| 806C-M0045-C02 | RYVMG | SIYPSGGYTYYADSVKG | DSPHCSGGSCYGGYYYYGMDV |
| 806C-M0045-C11 | HYIMV | SIYPSGGVTYYADSVKG | DVAGALDY |
| 806C-M0045-C12 | KYWMH | SIYSSGGRTHYADSVKG | TDSSTWYRWYFDL |
| 806C-M0045-D01 | AYKMT | SIYPSGGWTWYADSVKG | DNWQGGAFDI |
| 806C-M0045-D07 | RYLMM | SIYPSGGWTYYADSVKG | VAPYDSSGSVNYAFDP |
| 806C-M0045-G01 | HYKMV | VIYPSGGWTRYADSVKG | EMIDTISPGWHFDL |
| 806C-M0045-G10 | RYQMM | SIYPSGGFTRYADSVKG | SYYYGSGTYHYSYYGMDV |
| 806C-M0046-A11 | RYRMD | GIYPSGGHTYYADSVKG | LYLWGSYPTQVAFDI |
| 806C-M0046-B06 | MYPML | SIYPSGGMTYYADSVKG | QGYYDSSGWTFDY |
| 806C-M0046-B10 | AYVMN | GIYSSGGYIYYADSVKG | RHFNGVGFDL |
| 806C-M0046-G12 | NYKMN | VIYPSGGGTYYADSVKG | VGYSSGWFLFYGMDV |
| 806C-M0046-H03 | SYIMV | SIYPSGGHTPYADSVKG | QTGGYAHFDY |
| 806C-M0046-H10 | SYVMH | SIYPSGGWTLYADSVKG | AVGPFDY |
| 806C-M0046-H11 | RYKME | VIYPSGGHTNYADSVKC | GGYYDILTGYYKYYFDY |
| 806C-M0047-B03 | SYKMS | VIYPSGGWTWYADSVKG | MMYYYDSSGYLRADAFDI |
| 806C-M0047-D01 | AYKMM | SIYPSGGWTYYADSVKG | SMGYGDAFDI |
| 806C-M0047-D03 | VYPMA | WISPGGKTYYADSVKG | GSRHYDKFDY |
| 806C-M0047-E10 | HYKMA | VIYPSGGATYYADSVKG | ALPGGYFDY |
| 806C-M0047-G09 | WYRMV | GIYPSGGFTSYADSVKG | VYYYDSSGYYFVGGFDP |
| 806C-M0053-A02 | QYLMQ | SIYPSGGATYYADSVKG | RKDGYSRSAFDI |
| 806C-M0053-A03 | HYVMW | GIYPSGWTVYADSVKG | DLGGTRAFDY |
| 806C-M0053-A05 | NYPMT | RIYPSGGYTYYADSVKG | GRIAALDY |
| 806C-M0053-A09 | RYVMH | VIYPSGGATLYADSVKG | GQYSSGWYTEGWFDP |
| 806C-M0053-B09 | RYKMQ | SIYPSGGITYYADSVKG | GRGTTRAFDY |
| 806C-M0053-B11 | DYAMH | RIGSSGGHTSYADSVKG | DYYYDSSGYYYPAFDI |
| 806C-M0053-D03 | RYAMM | SIYPSGGSTYYADSVKG | VQGGAGAFDI |
| 806C-M0053-D06 | RYKMH | SIVPSGGWTYYADSVKG | QMYYYDSSGYYVGRFDI |
| 806C-M0053-D12 | SYMMF | RIYPSGGWTYYADSVKG | VTVPLDSGSYYFDY |
| 806C-M0053-E03 | NYKMW | SIYPSGGWTQYADSVKG | DVGGGFDY |
| 806C-M0053-E04 | HYKMG | SIYPSGGWTTYADSVKG | DSPLWPAAIKSGAYYYGMDV |
| 806C-M0053-E08 | RYVML | VIYPSGGYTYYADSVKG | GVLRAFDI |
| 806C-M0053-F04 | CYGMY | VISPSGGYTHYADSVKG | AYSSGWYLDY |
| 806C-M0053-F05 | SYMMF | RIYPSGGWTYYADSVKG | VTVPLDSGSYYFDY |

TABLE 5-continued

Heavy Chain Sequences

| Clone | HV-CDR1 | HV-CDR2 | HV-CDR3 |
|---|---|---|---|
| 806C-M0053-F06 | SYIMI | SIYPSGGQTYYADSVKG | KNGYNNVFDV |
| 806C-M0053-F08 | RYPML | SIYPSGGWTSYADSVKG | PTHNWNTDDPDAFDI |
| 806C-M0053-G04 | KYKML | VIYPSGGYTYYADSVKG | VVVPAFYYYYYMDV |
| 806C-M0053-G05 | KYKMD | SIYPSGGFTYYADSVKG | EKMATMDY |
| 806C-M0054-A08 | RYVMH | RIYPSGGWTYYADSVKG | VAGESNGMDV |
| 806C-M0054-B06 | IYKMQ | SIYPSGGATYYADSVKG | QTYYYDSSGYFRNAFDI |
| 806C-M0054-B08 | RYRMV | WIYPSGGWTSYADSVKG | SNYYDSAATLDI |
| 806C-M0054-C03 | HYQML | SIYPSGGWTYYADSVKG | VGYSSGWYALTSKTFDY |
| 806C-M0054-C07 | RYPMN | RIWPSGGSTVYADSVKG | DSSRYFDV |
| 806C-M0054-E04 | NYKMH | VIYPSGGVTEYADSVKG | DQYSGHDY |
| 806C-M0054-G01 | EYQMI | YIVPSGGFTAYADSVKG | VNYYGMDV |
| 806C-M0054-G05 | AYLME | GIYPSGGKTYYADSVKG | VNVISVAGTGYYYYGMDV |
| 806C-M0054-H10 | QYPMI | VISPSGGHTSYADSVKG | IQYYGGAFDI |
| 806C-M0055-A09 | KYRMS | GIYPSGGGTTYADSVKG | PTYYYDSSGYYYSGPIDY |
| 806C-M0055-B11 | AYKMH | VIYPSGGWTYYADSVKG | GTAGWFDP |
| 806C-M0055-B12 | NYKNT | SIYPSGGWTYYADSVKG | QEDGGYGT |
| 806C-M0055-C05 | QYKML | SIYPSGGWTSYADSVKG | ASYYDSGGYYRENFQF |
| 806C-M0055-C07 | SYKMH | VIYPSGGATYYADSVKG | GLDFWSGPDY |
| 806C-M0055-D03 | NYVMQ | VIYPSGGMTNYADSVKG | IRGDTRAFDI |
| 806C-M0055-D06 | KYKMW | VIYPSGGATYYADSVKG | SSLGCSSTSCYDAFDI |
| 806C-M0055-D12 | TYGMW | SISSGGSTVYADSVKG | DLTTVTGNYFDY |
| 806C-M0055-E04 | SYKMV | SIYPSGGVTIYADSVKG | DGSSSGWYNPRRAFDY |
| 806C-M0055-E06 | KYKMI | SIYPSGGHTIYADSVKG | EGGGATSFDY |
| 806C-M0055-E10 | AYPMF | VISPSGGQTSYADSVKG | SFSGLAALDF |
| 806C-M0055-E12 | QYTMY | SIYPSGGWTNYADSVKG | GRGGSKAFDI |
| 806C-M0055-F10 | AYVMS | RIYPSGGGTRYADSVKG | EAGGSYFLDY |
| 806C-M0055-G02 | SYKMI | GIYPSGGATGYADSVKG | DGGDIVVPDY |
| 806C-M0055-G03 | KYHMG | SIYSSGGTTQYADSVKG | GRVGGWSLFNWFDP |
| 806C-M0055-H04 | SYPMY | RIVPSGGWTNYADSVKG | DKGDWYFDL |
| 806C-M0056-A01 | RYANG | WIYPSGGITSYADSVKG | ITYFDTSVIDY |
| 806C-M0056-A06 | HYPME | RIVPSGGWTTYADSVKG | RVVTTYLDYFDY |
| 806C-M0056-B08 | VYVMS | SIYPSGGGTYYADSVKG | RKAAAGYLDY |
| 806C-M0056-B09 | HYKMS | SIYPSGGWTYYADSVKG | DRPGAFDV |
| 806C-M0056-C03 | SYKMW | VIYPSGGATYYADSVKG | GIGAVGGFDS |
| 806C-M0056-C04 | HYIMA | RIYPSGGKTYYADSVKG | QGGGGRAFDI |
| 806C-M0056-E08 | SYIMA | GIYPSGGFTTYADSVKG | IAGGAYHLDY |
| 806C-M0056-F01 | RYGME | SIYPSGGWTYYADSVKG | RGSGRYFDY |
| 806C-M0056-F02 | IYVMG | SIYPSGGYTWYADSVKG | QGGGGRAFDI |

TABLE 5-continued

Heavy Chain Sequences

| Clone | HV-CDR1 | HV-CDR2 | HV-CDR3 |
|---|---|---|---|
| 806C-M0056-F10 | RYKMI | YIVPSGGWTYYADSVKG | VDYYDFWSGYWWSGGYGMDV |
| 806C-M0056-F11 | RYVML | VIYPSGGYTYYADSVKG | GVLRAFDI |
| 806C-M0056-G03 | KYKMH | VIYPSGGKTYYADSVKG | EMGGSGWYDY |
| 806C-M0056-G04 | QYVMR | GIYPSGGWTYYADSVKG | VAAAGAFDI |
| 806C-M0056-G08 | HYGMW | VISPSGGQTNYADSVKG | GQIHGGNLAS |
| 806C-M0056-G12 | NYKMN | VIYPSGGATYYADSVKG | VGYSSSWDPHFDY |
| 806C-M0056-H04 | SYRMV | SIYPSGGPTRYADSVKG | WSYYYDSSGYYPVSGPFDI |
| 806C-M0056-H12 | MYKMH | VIYPSGGITAYADSVKG | EVMGPSDY |
| 806C-M0057-B05 | KYVMH | SIYPSGGWTYYADSVKG | STTYSSRPFDY |
| 806C-M0057-H07 | RYPMM | VIYSSGGYTYYADSVKG | VSRGIYYAMDV |
| 806C-M0058-A09 | NYKMH | SIYPSGGPTHYADSVKG | EGYSSGWYIHWYFDL |
| 806C-M0058-D04 | SYFMT | GISPSGGITSYADSVKG | GSYSDYGVFNS |
| 806C-M0058-E09 | NYVMA | VIYPSGGATYYADSVKG | LAVTHFDY |
| 806C-M0058-F03 | DYGMA | VISPSGGQTAYADSVKG | VRWFGAFDY |
| 806C-M0058-G03 | LYLMY | VIYPSGGWTYYADSVKG | GYYYGMDV |
| 806C-M0058-H01 | GYIMM | SIYPSGGHTYYADSVKG | WYYGMDV |
| 806C-M0059-A02 | MYQMQ | RIYPSGGWTVYADSVKG | ITYDSSGYYDY |
| 806C-M0059-A06 | PYKMI | GIYPSGGWTYYADSVKG | LLPALRGAVMDV |
| 806C-M0060-B02 | IYPMH | SIYPSGGITRYADSVKG | QRGSGWHDS |
| 806C-M0060-H01 | YYPMV | VIVPSGGFTAYADSVKG | KRPGNAFDI |
| 806C-M0061-A03 | YYKMW | SISPGGWTHYADSVKG | GPVSSGGDY |
| 806C-M0061-C05 | QYVMM | SIYPSGGQTYYADSVKG | IAGGAYHLDY |
| 806C-M0061-C06 | RYVMG | RIYPSGGFTYYADSVKG | IREGYFDY |
| 806C-M0061-F07 | HYVMT | SIYPSGGFTAYADSVTG | STYYYEGSGYYRAFDI |
| 806C-M0061-G12 | QYKMW | VIYPSGGVTYYADSVKG | SYSPVGAFDI |
| 806C-M0061-H09 | VYKMY | VIYPSGGYTDYADSVKG | QLPMSYFDY |
| 806C-M0062-A12 | RYVMV | RIYPSGGFTNYADSVKG | DKTAHMDV |
| 806C-M0062-B05 | RYKNN | SIYPSGGWTNYADSVKG | GGRYGDYVRH |
| 806C-M0062-B07 | RYRMA | SIYPSGGVTYYADSVKG | DLSIAAAGTAY |
| 806C-M0062-C08 | RYVMQ | SSIYPSGGATIYADSVKG | RGIPGYFDS |
| 806C-M0062-D04 | SYGMV | SISPSGGNTGYADSVKG | GNGGFDS |
| 806C-M0062-E02 | HYVMS | VIYPSGGWTGYADSVKG | GVATTSFDY |
| 806C-M0062-E03 | RYLMR | GIYPSGGITAYADSVKG | ASGSYYNYYFDY |
| 806C-M0062-E11 | AYVMH | RIYPSGGITYYADSVKG | GILTGPDY |
| 806C-M0062-F10 | RYKMS | YIYPSGGHTEYADSVKG | EREGTPDY |
| 806C-M0062-G06 | IYPMI | VIYPSGGHTRYADSVKG | RVYSSGSAYFDL |

TABLE 5-continued

Heavy Chain Sequences

| Clone | HV-CDR1 | HV-CDR2 | HV-CDR3 |
|---|---|---|---|
| 806C-M0062-H01 | MYKMA | YIYPSGGYTYYADSVKG | VRDSAFDI |
| TIE 1 E03 ref | MYGMV | VISPSGGNTGYADSVKG | APRGYSYGYYY |

TABLE 6

Light Chain Sequences

| Clone | LV-CDR1 | LV-CDR2 | LV-CDR3 |
|---|---|---|---|
| 806C-M0044-A06 | SGSSSSIGLNPVN | SNDQRPS | AAWDDSLNGPA |
| 806C-M0044-A11 | RASQSVSSSYLA | GASSRAT | QQYGSSPPGGT |
| 806C-M0044-B04 | RASQSISSYLN | AASSLQS | QQSYSTPPT |
| 806C-M0044-B05 | RASQSVSSYLA | DASNRAT | QQRSNWPPGIT |
| 806C-M0044-B08 | RASQYISIYLN | AASSLQS | QQYKSYPLT |
| 806C-M0044-B09 | QASQDISNYLN | HASNLET | LQYKSYPRL |
| 806C-M0044-B10 | TGTSSDVGSYNLVS | EGSKRPS | CSYAGSSTLV |
| 806C-M0044-B12 | RASQSISGWLA | KASTLKS | QQYNSYSQT |
| 806C-M0044-C07 | RSSQSLLHSNGYNYLD | LGSNRAS | MQALQTPQ |
| 806C-M0044-D01 | GGNNIGIKSVN | DDSGRPS | QVWDSGSDHWV |
| 806C-M0044-E03 | GGSNIGGKSVH | DDRDRPS | QVWDSGTDHRV |
| 806C-M0044-F03 | RGDRLRSYYSS | GRNNRPS | SSRDGSGNFL |
| 806C-M0044-F06 | RASQSVSGNLLA | GASSRAT | QQYGGSPPVT |
| 806C-M0044-F09 | RASQSVSSYLA | DASNRAT | QQRSNWPRT |
| 806C-M0044-G06 | RASQSVYNNLA | DASTTAT | QQRSNWPSLT |
| 806C-M0044-G07 | RATQGIGTFLA | GASTLQS | QQPNSF |
| 806C-M0044-G11 | RASQDISSWLV | DASNLQS | QQANSFPVT |
| 806C-M0044-H03 | SGSSSNVGSNNVN | SNNHRPS | ATWDDNLIAPV |
| 806C-M0044-H05 | TGSSSDVSGYNYVS | DVSNRPS | SSYTSSSTWV |
| 806C-M0044-H07 | RASQGIRNDLG | AASSLQS | LQDYNYPWT |
| 806C-M0044-H09 | RASQRVSTWVA | MASRLES | QQYNFYPRT |
| 806C-M0045-A02 | RASQGISNYLA | SASTLQT | QQFNSYPRT |
| 806C-M0045-A04 | QGDSLRNYHPS | GKNNRPS | NSRDSSGNHV |
| 806C-M0045-B01 | TGTSSDVGGYNYVS | EVSKRPS | SSYAGSNNLI |
| 806C-M0045-B03 | PASQSISRYLA | DASERAA | QQRGNWPLT |
| 806C-M0045-B11 | RASQSVSSYLA | DASNRAT | QQRSNWPHT |
| 806C-M0045-C02 | RASQSVSSNLA | GASSRAT | QQYGSSPRT |
| 806C-M0045-C11 | TGTNRDVGGYNYVS | DVSNRPS | SSYTSSGTRV |
| 806C-M0045-C12 | TGTSTDVGGYNYVS | DVSNRPS | SSYTNTTTVV |
| 806C-M0045-D01 | PASQSVSNWLA | KASTLES | QHYHRYSRT |
| 806C-M0045-D07 | RASQSVNSNQLA | GASNRAT | QQRSNFWT |

TABLE 6-continued

Light Chain Sequences

| Clone | LV-CDR1 | LV-CDR2 | LV-CDR3 |
|---|---|---|---|
| 806C-M0045-G01 | RASQNINIYLN | TQSNLRS | QQSHSAPRT |
| 806C-M0045-G10 | QGDSLRSYYAS | GKNNRPS | QSRGSSSGNHYV |
| 806C-M0046-A11 | RASQSVSSTYLA | GASSRAT | QHYGSSPLT |
| 806C-M0046-B06 | RASQSVSSNLA | GASTRAT | QQRSNWPLT |
| 806C-M0046-B10 | RASQSVSSYLA | DASNRAT | QQRSNWPLT |
| 806C-M0046-G12 | RASQSVSSSNLA | GASTRAT | QLYKT |
| 806C-M0046-H03 | TGSNTDVGRYNFVS | DVYKRPS | CSYARASTFSYV |
| 806C-M0046-H10 | RASQGIGTYLA | AASTLQS | QKYNSAPRP |
| 806C-M0046-H11 | SGNNSNFGSNTVT | SDSRRPS | AAWDDSLNGV |
| 806C-M0047-B03 | RASQRIGSYLN | GASNLES | QQTSSVSPLT |
| 806C-M0047-D01 | RASQSINEWLA | AASSLQS | QQYGSSPALT |
| 806C-M0047-D03 | RASQTIRSYLN | AASNLQS | QQSYSMSSWT |
| 806C-M0047-E10 | TGTSSDVGGYNYVS | DVSNRPS | SSYTSTATYVLGTGTRV |
| 806C-M0047-G09 | PASQSVSSSYLA | GASNRAT | MQATFWPYA |
| 806C-M0053-A02 | SGNNSNFGSNTVT | SDSRRPS | AAWDDSLNGV |
| 806C-M0053-A03 | RASQSVSSSYLA | GASSRAT | QQRGNWPRT |
| 806C-M0053-A05 | TGTSSDDVGGYNYVS | DVSDRPS | GSYRVTSVSRSYV |
| 806C-M0053-A09 | QGDTLRYFSAS | GANNRPS | NSRDGSGNWL |
| 806C-M0053-B09 | SGSSSNIGSNNVN | SNDQRPS | AAWDDSLNGPV |
| 806C-M0053-B11 | GGNDIGRKFVH | DDSDRPS | QVWDLSSDHWV |
| 806C-M0053-D03 | RASQSVSSSYLA | GASSRAT | QQYGSSPL |
| 806C-M0053-D06 | RASQSINTYLN | AASSLQS | QQSNSISTFT |
| 806C-M0053-D12 | RASQSVSSYLA | DASNRAT | QQRSNWPPRIT |
| 806C-M0053-E03 | RASQSVSSSYLA | GASSRAT | QQYGSSPQLT |
| 806C-M0053-E04 | RASQSVSSNLA | GASTRAT | LTRVT |
| 806C-M0053-E08 | SGSSYNIGVYDVY | TNNQRPS | AAWDDSLAGWV |
| 806C-M0053-F04 | RASQSVSSYLA | DTSNRAT | QQRSNWPIT |
| 806C-M0053-F05 | SGDNLGSRYIS | QDYRRPS | QAWDRSTAV |
| 806C-M0053-F06 | RASHSVTNNRLA | GASNRAA | QQRSHWLYT |
| 806C-M0053-F08 | TGTSSDVGSYNLVS | EGSKRPS | CSYAGSSTYV |
| 806C-M0053-G04 | GGNNIGTKSVN | DDNDRPS | QVWDPTGDQYV |
| 806C-M0053-605 | TGTSSDVGGYNYVS | EVSNRPS | SSYTSSSTLGGV |
| 806C-M0054-A08 | TGTSSDVGGCNYVS | DVSYRPS | SSCTSSSTL |
| 806C-M0054-B06 | RTSQSIDTYLN | GASSLES | QQSYTTSYT |
| 806C-M0054-B08 | TGATRDVS | EVNSRPS | SSTTSRAPRVI |
| 806C-M0054-C03 | RASQTISSYLN | AASTLQS | QQSYSTPS |
| 806C-M0054-C07 | RASHNIDNFLA | DASHRAT | QQRTNWL |
| 806C-M0054-E04 | RASQSISSNLA | GTSTRAT | QQYKDWPLT |

TABLE 6-continued

Light Chain Sequences

| Clone | LV-CDR1 | LV-CDR2 | LV-CDR3 |
| --- | --- | --- | --- |
| 806C-M0054-G01 | RASQSVSSYLA | DASNRAT | QQRYSWPLT |
| 806C-M0054-G05 | TGTNTDVGGYNYVS | DVSNRPS | SSYTSSSTWV |
| 806C-M0054-H10 | RASQSVSIYLA | DASNRAT | QQRSSWPIT |
| 806C-M0055-A09 | RASQSINNHLN | AASSLQS | QQSYSTPWT |
| 806C-M0055-B11 | TGTNTDVGGYNLVS | EVSNRPS | GSYTSSSTHV |
| 806C-M0055-B12 | TGTSSDVGSYNLVS | EGSKRPS | CSYAGSSTYV |
| 806C-M0055-C05 | QGDSLRSYYAT | GENNRPS | NSRDTSGSHLL |
| 806C-M0055-C07 | RASQSISIYLN | DASSLQS | QQSYSTPPMYT |
| 806C-M0055-D03 | WASQDIRTSLA | AASTLQG | QHLNGYPLT |
| 806C-M0055-D06 | RASQSVSSSYLA | GASSRAT | QLFGSSPRIT |
| 806C-M0055-D12 | RASQGISNYLA | AASTLQS | QKYNSAPWT |
| 806C-M0055-E04 | RASQSVSSQLA | GASSRAT | QHFGSSPPAT |
| 806C-M0055-E06 | SAEKLSEKYVA | QDSRRPS | QAWFSDSLP |
| 806C-M0055-E10 | RASQSVRTYLG | DASNEAT | QQRSNWPLT |
| 806C-M0055-E12 | RASQTVSSGSLA | GASRRGT | QQYGSTLPLT |
| 806C-M0055-F10 | TGTTSDVGGYNYVS | EVYNRPS | SSKTSSVTYV |
| 806C-M0055-G02 | TGTTSDVGRYNFVS | DVTRRPS | CSYAGSFYV |
| 806C-M0055-G03 | SGSSSNIGTNTVY | TNVQRPS | QSYDGSLSSAV |
| 806C-M0055-H04 | RASQSVSSYLA | DASNRAT | QQRSNWPRT |
| 806C-M0056-A01 | RASQSVSRYLA | DTSNRAT | QQRSNWPPALT |
| 806C-M0056-A06 | TGTSSNVGNYNTLVS | EDNKRPS | CSYAGSGTC |
| 806C-M0056-B08 | TGTSSDIGAYKHVS | EVTNRPS | SSYTSRNTWV |
| 806C-M0056-B09 | RASQSVSSSYLA | DASSRAT | QQYGRSPS |
| 806C-M0056-C03 | RASQSVSSSYLA | GASSRAT | QQYNSYPIT |
| 806C-M0056-C04 | RASHDISDNLN | DAFNLEA | QQFNNVPYT |
| 806C-M0056-E08 | QCDSLRNYYAS | GKNNRPS | SSRDTTNYRIVIE |
| 806C-M0056-F01 | RASQSVSSYLA | DASNRAT | QQRSNWPPALT |
| 806C-M0056-F02 | TGTSSDVGYYNYVS | EVSNRPS | SSYAGSDNFV |
| 806C-M0056-F10 | TGTSSDVGGYNYVS | DVSNRPS | SSYTSSSTLFYV |
| 806C-M0056-F11 | RASQGISTYLA | ATSTLQS | QQLNSYPIT |
| 806C-M0056-G03 | RASQSISSYLA | DASNRAT | QQYGSLPRT |
| 806C-M0056-G04 | RASQSVSSYLA | GASSRAT | QQYGSSRHT |
| 806C-M0056-G08 | RASQSISSYLA | GTSNRAT | QQRYKWPLT |
| 806C-M0056-G12 | TGTSSDVGGYNYVS | DVSNRPS | SSYTSSSTLYV |
| 806C-M0056-H04 | RASQSVSSSYLA | GASSRAT | QQKDWPRT |
| 806C-M0056-H12 | RASQGVRSTYLA | CASSRAT | QQYGSSQGFT |
| 806C-M0057-B05 | RSSQSLSNNLA | GASTRAT | QQANSFPRT |
| 806C-M0057-H07 | RASQSIDTYLN | AASKLED | QQSYSSPGIT |

TABLE 6-continued

Light Chain Sequences

| Clone | LV-CDR1 | LV-CDR2 | LV-CDR3 |
|---|---|---|---|
| 806C-M0058-A09 | PASQSVSSSYLA | GASSRAT | QQYGRSRYT |
| 806C-M0058-D04 | RASQSIDTYLN | DASNLET | QQADSFPIT |
| 806C-M0058-E09 | RASQSISSSLA | DASNRAT | QQRSNWPLT |
| 806C-M0058-F03 | RASQGISNYLA | GASNLQS | QQFNSYPLT |
| 806C-M0058-G03 | RASQSVTSSFLS | ATSTRAT | QHYHTSPPTYT |
| 806C-M0058-H01 | GGENIGSKSVH | YDNDRPS | QVWDSGSEHYV |
| 806C-M0059-A02 | TGTNSDVGGYNYVS | DVTNRPS | SSYSSTSPR |
| 806C-M0059-A06 | RASQSIDTYLN | AASKLED | QQSYSSPGIT |
| 806C-M0060-B02 | RGDRLRSYYSS | GRNNRPS | SSRDGSGNFL |
| 806C-M0060-H01 | RASQSVSSYLA | DASNRAT | QQRSNWPVT |
| 806C-M0061-A03 | RASQDISRFLA | SASTLQS | QQLSRYST |
| 806C-M0061-C05 | RASQSVSSYLA | DASNRAT | QQRSNWPPLT |
| 806C-M0061-C06 | TGTSSDVGGYNYVS | DVTKRPS | GSYTSSGSRV |
| 806C-M0061-F07 | RASQSIDTYLN | AASKLED | QQSYSSPGIT |
| 806C-M0061-G12 | RASQSVSSSYLA | GASNRAT | QKYGSSSLT |
| 806C-M0061-H09 | TGTSSDVGSYNRVS | DINNRPS | SSFTSSSTYI |
| 806C-M0062-A12 | RSSQSLLQSNGYNYLD | LGSNRAS | MQALQTWT |
| 806C-M0062-B05 | RASQSVSSYLA | DASNRAT | QQRSSWPPLT |
| 806C-M0062-B07 | RASQSVSSNLA | GASIRAT | QQYKDWPRT |
| 806C-M0062-C08 | RASQSFVGSRNLA | GAFNRAT | QQYGTSPRT |
| 806C-M0062-D04 | RASQSISTYLN | ATSTLQS | QQFNFYPLT |
| 806C-M0062-E02 | TGTSSDVGSYNLVS | EGSKRPS | CSYAGSSTYV |
| 806C-M0062-E03 | RASQSVSSYLA | DASNRAT | QQRSNWPRSIT |
| 806C-M0062-E11 | RASQSIDTYLN | AASKLED | QQSYSSPGIT |
| 806C-M0062-F10 | SLSSGHSSYAIA | KVNSDGSHTKGD | QTWGTGSWV |
| 806C-M0062-G06 | TGTSSDDVGGYNYVS | DVINRPS | SSYASSGARV |
| 806C-M0062-H01 | RASQSVAGLLA | KASILET | QQYSFNSGT |
| TIE 1 E03 ref | RASQGIGHYLA | TASTLQS | QQFNSYPHT |

Some antibodies described herein include related variable domains. The same variable domain can function with a different partner variable domain. For example, M0044-G06 and M0044-B05 share a HC variable domain, but have different LC variable domains, as do M0044-G07 and M0044-B05. Other antibodies that have the same HC variable domain include:

HC 54(M0053-D12) and 19(M0044-H05);
HC 59(M0053-F05) and 19(M0044-H05);
HC 72(M0054-H10) and 25(M0045-B03); and
HC 98(M0056-F11) and 57(M0053-E08).

Some antibodies that have the same LC variable domain include:

LC 114(M0059-A06) and 106(M0057-H07);
LC 130(M0062-E11) and 106(M0057-H07); and
LC 115(M0060-B02) and 12(M0044-F03).

Some antibodies have the same CDR3. For example, the CDR3 sequence, QGGGGRAFDI, is present in M0056-C04 and M0056-F02. The CDR3 sequence IAGGAYHLDY is present in M0056-E08 and M0061-C05.

In some cases, an antibody can include a non-germline residue. One or more of such non-germline residues can be modified, e.g., to restore the germline residue. Exemplary non-germline residues include: L45F (see, e.g., M0053-D06); V48F (see, e.g., M0062-C08); delta S53 (see, e.g., M0045-B01; M0047-D03; M0055-D12; M0061-A03); delta G54 (see, e.g., M0053-A03); T57I (see, e.g., M0046-B10);

E85D (see, e.g., M0056-H12); T87M (see, e.g., M0053-F06; M0055-E12; M0056-B08); V89L (see, e.g., M0044-B08; M0047-D01; M0060-B02; M0062-H01); V89M (see, e.g., M0044-B10; M0045-C12; M0045-D07; M0053-B11; M0055-B12; M0055-E06; M0056-A01; M0056-G12; M0058-G03; M0059-A06; M0060-H01; M0061-F07); V89T (see, e.g., M0044-H07; M0046-A11; M0046-B10; M0047-D03; M0055-C07; M0055-D03; M0055-G02); A93T (see, e.g., M0045-A02; M0053-F08; M0056-H12; M0058-E09; M0059-A02; M0061-C06; M0062-G06); and T107K (see, e.g., M0045-B03).

Example 33

Sequence of DX-2220 Antibody

DX-2220 is a full length, IgG1, germlined human anti-Tie1 antibody E3b.
The sequence of DX-2220 is as follows:
DX-2220 Light Chain Amino Acid Sequence:

(SEQ ID NO: 700)
DIQMTQSPSSLSASVGDRVTITCRASQGIGHYLAWYQQKPGKVPKLLIYT

ASTLQSGVPSRFSGSGSGTDFTLTISSLQPEDVATYYCQQFNSYPHTFGQ

GTRLEIKRTVAAPSVFIFPPSDEQLKSGTASVVCLLNNFYPREAKVQWKV

DNALQSGNSQESVTEQDSKDSTYSLSSTLTLSKADYEKIHKVYACEVTHQ

GLSSPVTKSFNRGEC**

DX-2220 Heavy Chain Amino Acid Sequence:

(SEQ ID NO: 701)
EVQLLESGGGLVQPGGSLRLSCAASGFTFSMYGMVWVRQAPGKGLEWVSV

ISPSGGNTGYADSVKGRFTISRDNSKNTLYLQMNSLRAEDTAVYYCARAP

RGYSYGYYYWGQGTLVTVSSASTKGPSVFPLAPSSKSTSGGTAALGCLVK

DYFPEPVTVSWNSGALTSGVHTFPAVLQSSGLYSLSSVVTVPSSSLGTQT

YICNVNHKPSNTKVDKKVEPKSCDKTHTCPPCPAPELLGGPSVIFLFPPK

PKDTLMISRTPEVTCVVVDVSHEDPEVKFNWYVDGVEVHNAKTKPREEQY

NSTYRVVSVLTVLHQDWLNGKEYKCKVSNKALPAPIIEKTISKAKGQPRE

PQVYTLPPSRDELTKNQVSLTCLVKGFYPSDIAVEWESNGQPENNYKTTP

PVLDSDGSFFLYSKLTVDKSRWQQGNVFSCSVMHEALHNIHYTQKSLSLS

PGK*

DX-2220 Light Chain Nucleotide Sequence:

(SEQ ID NO: 702)
ggcgtgcactctgacatccagatgacccagtctccatcctccctgtctgc atctgtaggagacagagtcaccatcacttgccgggcgagtcagggcattg gccattatttagcctggtatcagcagaaaccagggaaagttcctaagctc ctgatctatactgcatccactttgcaatcaggggtcccatctcggttcag tggcagtggatctgggacagatttcactctcaccatcagcagcctgcagc ctgaagatgttgcaacttattactgtcaacagtttaatagttaccctcac accttcggccaagggacacgactggagattaaacgaactgtggctgcacc atctgtcttcatcttcccgccatctgatgagcagttgaaatctggaactg cctctgttgtgtgcctgctgaataacttctatcccagagaggccaaagta cagtggaaggtggataacgccctccaatcgggtaactcccaggagagtgt cacagagcaggacagcaaggacagcacctacagcctcagcagcaccctga cgctgagcaaagcagactacgagaaacacaaagtctacgcctgcgaagtc acccatcagggcctgagctcgcccgtcacaaagagcttcaacaggggaga gtgttaataa DX-2220 Heavy Chain Nucleotide Sequence:

(SEQ ID NO: 703)
gaagttcaattgttagagtctggtggcggtcttgttcagcctggtggttc tttacgtctttcttgcgctgcttccggattcactttctctatgtacggta tggtttgggttcgccaagctcctggtaaaggtttggagtgggtttctgtt atctctccttctggtggcaatactggttatgctgactccgttaaaggtcg cttcactatctctagagacaactctaagaatactctctacttgcagatga acagcttaagggctgaggacactgcagtctactattgtgcgagagcccca cgtggatacagctatggttactactactggggccagggaaccctggtcac cgtctcaagcgcctccaccaagggcccatcggtcttcccgctagcaccct cctccaagagcacctctgggggcacagcggccctgggctgcctggtcaag gactacttccccgaaccggtgacggtgtcgtggaactcaggcgccctgac cagcggcgtccacaccttcccggctgtcctacagtcctcaggactctact ccctcagcagcgtagtgaccgtgccctccagcagcttgggcacccagacc tacatctgcaacgtgaatcacaagcccagcaacaccaaggtggacaagaa agttgagcccaaatcttgtgacaaaactcacacatgcccaccgtgcccag cacctgaactcctggggggaccgtcagtcttcctcttccccccaaaaccc aaggacaccctcatgatctcccggacccctgaggtcacatgcgtggtggt ggacgtgagccacgaagaccctgaggtcaagttcaactggtacgtggacg gcgtggaggtgcataatgccaagacaaagccgcgggaggagcagtacaac agcacgtaccgtgtggtcagcgtcctcaccgtcctgcaccaggactggct gaatggcaaggagtacaagtgcaaggtctccaacaaagcccctcccagccc ccatcgagaaaaccatctccaaagccaaagggcagccccgagaaccacag gtgtacaccctgcccccatcccgggatgagctgaccaagaaccaggtcag cctgacctgcctggtcaaaggcttctatcccagcgacatcgccgtggagt gggagagcaatgggcagccggagaacaactacaagaccacgcctcccgtg ctggactccgacggctccttcttcctctacagcaagctcaccgtggacaa gagcaggtggcagcaggggaacgtcttctcatgctccgtgatgcatgagg ctctgcacaaccactacacgcagaagagcctctccctgtctccgggtaaa tga

Example 34

DX-2220 Slows Xenograft Tumor Progression in Nude Mice

Mice (nu/nu) were implanted subcutaneously with $5\times10^6$ SW-480 (colorectal cancer) cells. After 12 days, when tumors reached approximately 100-200 mg, the mice were separated into 5 groups and treated with the following agents (or left untreated):
1—Untreated
2—Vehicle (PBS)
3—Cisplatin (4 mg/kg/, IV, q2d×5 times)
4—A2-SV (negative control antibody @ 10 mg/kg, IP, q2d×14 times)
5—DX-2220 (anti-Tie-1 antibody @ 10 mg/kg, IP, q2d×14 times)

Throughout the study, the length (L) and width (W) of any tumors that developed were measured in millimeters using calibrated vernier calipers, where L is the longer of the two dimensions. When applicable, tumor weight (M) in milligrams was calculated by using the formula associated with a prolate ellipsoid: $M=(L\times W^2)/2$. Table 7 shows the average weights (in mg) of the tumors for each of the groups. A2-SV is an isotype matched (IgG1) negative control antibody that binds strepavidin.

TABLE 7

| | Tumor Weight (mg) | | | | |
|---|---|---|---|---|---|
| Days after Cell Injection | Group 1 Untreated | Group 2 Vehicle | Group 3 Cisplatin | Group 4 A2-SV | Group 5 DX-2220 |
| 5 | 57 | 95 | 48 | 111 | 112 |
| 9 | 88 | 117 | 69 | 120 | 137 |
| 12 | 118 | 139 | 137 | 149 | 139 |
| 15 | 153 | 203 | 185 | 159 | 145 |
| 19 | 202 | 309 | 207 | 308 | 186 |
| 22 | 316 | 431 | 235 | 350 | 224 |
| 26 | 403 | 532 | 310 | 405 | 292 |
| 28 | 449 | 587 | 363 | 526 | 328 |

The results from the animal study shown in Table 7 are depicted graphically in FIG. 5. DX-2220 slowed tumor progression by 44% when compared to vehicle (PBS)-treated control animals. In addition, DX-2220 was as efficacious as the chemotherapeutic control (cisplatin).

---

SEQUENCE LISTING (721 sequences)

SEQ ID NO: 1 - DNA, 3417 bp, Homo sapiens
  CDS (1)...(3414)
atggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagcttgtgcccctggtcattttggggctgattgccgactccagtgccagtgtcagaatggtggcacttgtgaccggttcagtggttgtgtctgcccctctgggtggcatggagtgcactgtgagaagtcagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctgtccaccaaggccattgtggagccagagaagaccacagctgagttcgaggtgccccgcttggttcttgcggacagtgggttctgggagtgccgtgtgtccacatctggcggccaagacagccggcgcttcaaggtcaatgtgaaagtgccccccgtgcccctggctgcacctcggctcctgaccaagcagagccgccagcttgtggtctccccgctggtctcgttctctggggatggacccatctccactgtccgcctgcactaccggccccaggacagtaccatggactggtcgaccattgtggtggaccccagtgagaacgtgacgttaatgaacctgaggccaaagacaggatacagtgttcgtgtgcagctgagccggccaggggaaggaggagagggggcctgggggcctcccaccctcatgaccacagactgtcctgagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgcactgccctcctgacgggactcacgcctggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggccgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctga

SEQ ID NO: 2 - protein, 1138 aa, Homo sapiens
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWHGVHCEKSDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 3 - DNA, 396 bp, Artificial Sequence
  Synthetically generated oligonucleotide
  CDS (1)...(396)
gaagttcaattgttagagtctggtggcggtcttgttcagcctggtggttctttacgtctttcttgcgctgcttccggattcactttctctatttacaagatgtcttgggttcgccaagctcctggtaaaggtttggagtgggtttcttctatctatccttctggtggccagactaagtatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggc

SEQ ID NO: 4 - protein, 132 aa, Artificial Sequence
  Synthetically generated peptide
EVQLLESGGGLVQPGGSLRLSCAASGFTFSIYKMSWVRQAPGKGLEWVSSIYPSGGQTKYADSVKGRFTISRDNSKNTLYLQMNSLRAEDTAVYYCARVNYYDSSGYGPIAPGLDYWGQGTLVTVSSASTKG

SEQ ID NO: 5 - DNA, 311 bp, Artificial Sequence
  Synthetically generated oligonucleotide
  CDS (1)...(309)
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcccggtggacgttcggccaagggac

SEQ ID NO: 6 - protein, 103 aa, Artificial Sequence
  Synthetically generated peptide
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSRWTFGQG

SEQ ID NO: 7 - DNA, 396 bp, Artificial Sequence
  Synthetically generated oligonucleotide
  CDS (1)...(396)
gaagttcaattgttagagtctggtggcggtcttgttcagcctggtggttctttacgtctttcttgcgctgcttccggattcactttctcttattaccttatgtattgggttcgccaagctcctggtaaaggtttggagtgggtttcttctatctatccttctggtggctggactgtttatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggc

SEQ ID NO: 8 - protein, 132 aa, Artificial Sequence
  Synthetically generated peptide
EVQLLESGGGLVQPGGSLRLSCAASGFTFSYYLMYWVRQAPGKGLEWVSSIYPSGGWTVYADSVKGRFTISRDNSKNTLYLQMNSLRAEDTAVYYCARVNYYDSSGYGPIAPGLDYWGQGTLVTVSSASTKG

SEQ ID NO: 9 - DNA, 308 bp, Artificial Sequence
  Synthetically generated oligonucleotide
  CDS (1)...(306)
caagacatccagatgacccagtctccatcctccctgtctgcatctgtcggagacagagtcaccatcacttgccgggcaagttagagcattagcacctctttaaattggtatcagcaaaaatcagggaaagcccctaagctcctgatatatgctgcatccagtttgcaaagtgaagtcccatcaaggttcagtggcagtggatctgggacagatttcactctcaccatcaccagtctgcaacctgaagattttgcaacttactactgtcaacagagttacagtacccctccgactttcggccaagggac

SEQ ID NO: 10 - protein, 101 aa, Artificial Sequence
  Synthetically generated peptide
QDIQMTQSPSSLSASVGDRVTITCRASSISTSLNWYQQKSGKAPKLLIYAASSLQSEVPSRFSGSGSGTDFTLTITSLQPEDFATYYCQQSYSTPPTFGQG

SEQ ID NO: 11 - DNA, 439 bp, Artificial Sequence
  Synthetically generated oligonucleotide
  CDS (1)...(438)
gaagttcaattgttagagtctggtggcggtcttgttcagcctggtggttctttacgtctttcttgcgctgcttccggattcactttctctatgtacgttatgaagtgggttcgccaagctcctggtaaaggtttggagtgggtttcttctatctatccttctggtggctatactcgttatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggcccatcggtcttcccgctagcaccctcctccaagagcacctctg

SEQ ID NO: 12 - protein, 146 aa, Artificial Sequence
  Synthetically generated peptide
EVQLLESGGGLVQPGGSLRLSCAASGFTFSMYVMKWVRQAPGKGLEWVSSIYPSGGYTRYADSVKGRFTISRDNSKNTLYLQMNSLRAEDTAVYYCARVNYYDSSGYGPIAPGLDYWGQGTLVTVSSASTKGPSVFPLAPSSKSTS

SEQ ID NO: 13 - DNA, 311 bp, Artificial Sequence
  Synthetically generated oligonucleotide
  CDS (1)...(309)
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctccctattcactttcggccctgggac

SEQ ID NO: 14 - protein, 103 aa, Artificial Sequence
  Synthetically generated peptide
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSLFTFGPG

SEQ ID NO: 15 - DNA, 439 bp, Artificial Sequence
  Synthetically generated oligonucleotide
  CDS (1)...(438)
gaagttcaattgttagagtctggtggcggtcttgttcagcctggtggttctttacgtctttcttgcgctgcttccggattcactttctcttcttacaagatgggttgggttcgccaagctcctggtaaaggtttggagtgggtttcttggatctatccttctggtggcggtactacttatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggcccatcggtcttcccgctagcaccctcctccaagagcacctctg

SEQ ID NO: 16 - protein, 146 aa, Artificial Sequence
  Synthetically generated peptide
EVQLLESGGGLVQPGGSLRLSCAASGFTFSSYKMGWVRQAPGKGLEWVSWIYPSGGGTTYADSVKGRFTISRDNSKNTLYLQMNSLRAEDTAVYYCARVNYYDSSGYGPIAPGLDYWGQGTLVTVSSASTKGPSVFPLAPSSKSTS

SEQ ID NO: 17 - DNA, 311 bp, Artificial Sequence
  Synthetically generated oligonucleotide
  CDS (1)...(309)
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggac

SEQ ID NO: 18 - protein, 103 aa, Artificial Sequence
  Synthetically generated peptide
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQG

SEQ ID NO: 19 - DNA, 446 bp, Artificial Sequence
  Synthetically generated oligonucleotide
  CDS (1)...(444)
gaagttcaattgttagagtctggtggcggtcttgttcagcctggtggttctttacgtctttcttgcgctgcttccggattcactttctctcgttaccctatggtttgggttcgccaagctcctggtaaaggtttggagtgggtttctgttatctctccttctggtggccagactttttatgctgactccgttaaaggtcgcttcactatctctagagacaactctaagaatactctctacttgcagatgaacagcttaagggctgaggacactgcagtctactattgtgcgagaggggtcctcaccaccgcttttgatatctggggccaagggacaatggtcaccgtctcaagcgcctccaccaagggcccatcggtcttcccgctagcaccctcctccaaagcacctctgggggcacagcggccctgggctgcctggtcaaggac

SEQ ID NO: 20 - protein, 148 aa, Artificial Sequence
  Synthetically generated peptide
EVQLLESGGGLVQPGGSLRLSCAASGFTFSRYPMVWVRQAPGKGLEWVSVISPSGGQTFYADSVKGRFTISRDNSKNTLYLQMNSLRAEDTAVYYCARGVLTTAFDIWGQGTMVTVSSASTKGPSVFPLAPSSKAPLGAQRPWAAWSR

SEQ ID NO: 21 - DNA, 308 bp, Artificial Sequence
  Synthetically generated oligonucleotide
  CDS (1)...(306)
caagacatccagatgacccagtctccatcctccctgtctgcatctgtgggagacagagtcaccatcacttgccgggcaagtcagaacattaacagctatttaaattggtatcagcagaaaccagggcaagcccctaaactcctgatctatgctgcctccaatttggaaactgcggtcccatcaaggttcagcggcagtggatctgggacagatttcactctcaccatcagtagcctgcagcctgaagattttgcaacttattattgtcaacaatttaatacttaccctctcactttcggcggagggac

SEQ ID NO: 22 - protein, 102 aa, Artificial Sequence
  Synthetically generated peptide
QDIQMTQSPSSLSASVGDRVTITCRASQNINSYLNWYQQKPGQAPKLLIYAASNLETAVPSRFSGSGSGTDFTLTISSLQPEDFATYYCQQFNTYPLTFGGG

SEQ ID NO: 23 - DNA, 393 bp, Artificial Sequence
  Synthetically generated oligonucleotide
  CDS (1)...(393)
gaagttcaattgttagagtctggtggcggtcttgttcagcctggtggttctttacgtctttcttgcgctgcttccggattcactttctctcgttacggtatgcattgggttcgccaagctcctggtaaaggtttggagtgggtttctgttatctctccttctggtggcatgacttattatgctgactccgttaaaggtcgcttcactatctctagagacaacactaagaatactctctacttgcagatgaacagcttaagggctgaggacactgcagtctactattgtgcgagagtgggagctaccgggccttttgatatctggggccaagggacaatggtcaccgtctcaagcgcctccaccaagggcccatcggtcttcccgctagcaccc

SEQ ID NO: 24 - protein, 131 aa, Artificial Sequence
  Synthetically generated peptide
EVQLLESGGGLVQPGGSLRLSCAASGFTFSRYGMHWVRQAPGKGLEWVSVISPSGGMTYYADSVKGRFTISRDNTKNTLYLQMNSLRAEDTAVYYCARVGATGPFDIWGQGTMVTVSSASTKGPSVFPLAP

SEQ ID NO: 25 - DNA, 308 bp, Artificial Sequence
  Synthetically generated oligonucleotide
  CDS (1)...(306)
caagacatccagatgacccagtctccagccaccctgtctttgtctccaggggaaagagccaccctctcctgcagggccagtcagagtgttagcacctacttagcctggtaccaacagaaacctggccaggctcccaggcttctcatctatgatgcatccaacagggccactggcatcccaggcaggttcagtggcagtgggtctgggacagacttcactctcaccatcagcagcctagaggctgaagactttgcagtttattactgtcagcagcgtagcagctggccgatcaccttcggccaagggac

SEQ ID NO: 26 - protein, 102 aa, Artificial Sequence
  Synthetically generated peptide
QDIQMTQSPATLSLSPGERATLSCRASQSVSTYLAWYQQKPGQAPRLLIYDASNRATGIPGRFSGSGSGTDFTLTISSLEAEDFAVYYCQQRSSWPITFGQG

SEQ ID NO: 27 - DNA, 429 bp, Artificial Sequence
  Synthetically generated oligonucleotide
  CDS (1)...(429)
gaagttcaattgttagagtctggtggcggtcttgttcagcctggtggttctttacgtctttcttgcgctgcttccggattcactttctctcattacggtatgacttgggttcgccaagctcctggtaaaggtttggagtgggtttctgttatctctccttctggtggccagactggttatgctgactccgttaaaggtcgcttcactatctctagagacaactctaagaatactctctacttgcagatgaacagcttaagggctgaggacactgcagtctactattgtgcgggtggtggctacgcagcctttgactactggggccagggaaccctggtcaccgtctcaagcgcctccaccaagggcccatcggtcttcccgctagcaccctcctccaagagcacctctgggggcacagcggccctgggc

SEQ ID NO: 28 - protein, 143 aa, Artificial Sequence
  Synthetically generated peptide
EVQLLESGGGLVQPGGSLRLSCAASGFTFSHYGMTWVRQAPGKGLEWVSVISPSGGQTGYADSVKGRFTISRDNSKNTLYLQMNSLRAEDTAVYYCAGGGYAAFDYWGQGTLVTVSSASTKGPSVFPLAPSSKSTSGGTAALG

SEQ ID NO: 29 - DNA, 308 bp, Artificial Sequence
  Synthetically generated oligonucleotide
  CDS (1)...(306)
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggac

SEQ ID NO: 30 - protein, 102 aa, Artificial Sequence
  Synthetically generated peptide
QDIQMTQSPATLSLSPGERATLSCRASQSVSSYLAWYQQKPGQAPRLLIYDASNRATGIPARFSGSGSGTDFTLTISSLEPEDFAVYYCQQRSNWPLTFGGG

SEQ ID NO: 31 - DNA, 396 bp, Artificial Sequence
  Synthetically generated oligonucleotide
  CDS (1)...(396)
gaagttcaattgttagagtctggtggcggtcttgttcagcctggtggttctttacgtctttcttgcgctgcttccggattcactttctctgcttaccgtatggagtgggttcgccaagctcctggtaaaggtttggagtgggtttcttctatctatccttctggtggcattacttattatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggc

SEQ ID NO: 32 - protein, 132 aa, Artificial Sequence
  Synthetically generated peptide
EVQLLESGGGLVQPGGSLRLSCAASGFTFSAYRMEWVRQAPGKGLEWVSSIYPSGGITYYADSVKGRFTISRDNSKNTLYLQMNSLRAEDTAVYYCARVNYYDSSGYGPIAPGLDYWGQGTLVTVSSASTKG

SEQ ID NO: 33 - DNA, 308 bp, Artificial Sequence
  Synthetically generated oligonucleotide
  CDS (1)...(306)
caagacatccagatgacccagtctccatcctccctgtctgcatctgtaggagacagagttaccatcacttgccgggcaagtcagggcattaccacttatttaggctggtattagcagaaaccagggaaagcccctaagctcctgatctatgctgcatccactttgcaaagtggggtcccagcaaagttcagcggcagtggatctgggacacttttcactctcaccatcagcggtctgcaacctgaagattctgcaacttactactgtcaccagagttacaataccccttggacgttcggccaagggac

SEQ ID NO: 34 - protein, 101 aa, Artificial Sequence
  Synthetically generated peptide
QDIQMTQSPSSLSASVGDRVTITCRASQGITTYLGWYQKPGKAPKLLIYAASTLQSGVPAKFSGSGSGTLFTLTISGLQPEDSATYYCHQSYNTPWTFGQG

SEQ ID NO: 35 - DNA, 412 bp, Artificial Sequence
  Synthetically generated oligonucleotide
  CDS (1)...(411)
gaagttcaattgttagagtctggtggcggtcttgttcagcctggtggttctttacgtctttcttgcgctgcttccggattcactttctctggttacggtatgcattgggttcgccaagctcctggtaaaggtttggagtgggtttctgttatctctccttctggtggccagacttggtaggctgactccgttaaaggtcgcttcactatctctagagacaactctaagaatactctctacttgcagatgaacagcttaagggctgaggacactgcagtctactattgtgcgagaggcgggaccagtaacccactgttttactggggccagggaaccctggtcaccgtctcaagcgcctccaccaagggcccatcggtcttcccgctagcaccctcctccaagagcacctctg

SEQ ID NO: 36 - protein, 136 aa, Artificial Sequence
  Synthetically generated peptide
EVQLLESGGGLVQPGGSLRLSCAASGFTFSGYGMHWVRQAPGKGLEWVSVISPSGGQTWADSVKGRFTISRDNSKNTLYLQMNSLRAEDTAVYYCARGGTSNPLFYWGQGTLVTVSSASTKGPSVFPLAPSSKSTS

SEQ ID NO: 37 - DNA, 308 bp, Artificial Sequence
  Synthetically generated oligonucleotide
  CDS (1)...(306)
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgacttttggccaggggac

SEQ ID NO: 38 - protein, 102 aa, Artificial Sequence
  Synthetically generated peptide
QDIQMTQSPATLSLSPGERATLSCRASQSVSSYLAWYQQKPGQAPRLLIYDASNRATGIPARFSGSGSGTDFTLTISSLEPEDFAVYYCQQRSNWPPTFGQG

SEQ ID NO: 39 - DNA, 444 bp, Artificial Sequence
  Synthetically generated oligonucleotide
  CDS (1)...(444)
gaagttcaattgttagagtctggtggcggtcttgttcagcctggtggttctttacgtctttcttgcgctgcttccggattcactttctctggttacggtatgcattgggttcgccaagctcctggtaaaggtttggagtgggtttctgttatctctccttctggtggccagacttcttatgctgactccgttaaaggtcgcttcactatctctagagacaactctaagaatactctctacttgcagatgaacagcttaagggctgaggacactgcagtctactattgtgcgagagataggcagtattactatggttcggggagtcttgactactggggccagggaaccctggtcaccgtctcaagcgcctccaccaagggcccatcggtcttcccgctagcaccctcctccaagagcacctctgggggcacagcggccctgggc

SEQ ID NO: 40 - protein, 148 aa, Artificial Sequence
  Synthetically generated peptide
EVQLLESGGGLVQPGGSLRLSCAASGFTFSGYGMHWVRQAPGKGLEWVSVISPSGGQTSYADSVKGRFTISRDNSKNTLYLQMNSLRAEDTAVYYCARDRQYYYGSGSLDYWGQGTLVTVSSASTKGPSVFPLAPSSKSTSGGTAALG

SEQ ID NO: 41 - DNA, 308 bp, Artificial Sequence
  Synthetically generated oligonucleotide
  CDS (1)...(306)
caagacatccagatgacccagtctccatcctccctgtctgcatctgtaggagacagagtcaccgtcacttgccgggcaagtcagagcattagcagttatttaaattggtatcagcagaaaccagggaaagcccctaaactcctgatctatgctgcatccagtttgcaaagtggggtcccatcaaggttcagtggcggtggatctgggacagatttcactctcaccatcagcagtctgcaacctgaagattttgcaacttatttctgtctacaagattacaaatacccgtggacgttcggccaagggac

SEQ ID NO: 42 - protein, 102 aa, Artificial Sequence
  Synthetically generated peptide
QDIQMTQSPSSLSASVGDRVTVTCRASQSISSYLNWYQQKPGKAPKLLIYAASSLQSGVPSRFSGGGSGTDFTLTISSLQPEDFATYFCLQDYKYPWTFGQG

SEQ ID NO: 43 - DNA, 375 bp, Artificial Sequence
  Synthetically generated oligonucleotide
  CDS (1)...(375)
gaagttcaattgttagagtctggtggcggtcttgttcagcctggtggttctttacgtctttcttgcgctgcttccggattcactttctctatgtacggtatgggttgggttcgccaagctcctggtaaaggtttggagtgggtttctgttatctctccttctggtggccagactgcttatgctgactccgttaaaggtcgcttcactatctctagagacaactctaagaatactctctacttgcagatgaacagcttaagggctgaggacactgcagtctactattgtgcgagagtggccttgctcctgggccacgcttttgatatctggggccaagggacaatggtcaccgtctcaagcgcctccaccaagggc

SEQ ID NO: 44 - protein, 125 aa, Artificial Sequence
  Synthetically generated peptide
EVQLLESGGGLVQPGGSLRLSCAASGFTFSMYGMGWVRQAPGKGLEWVSVISPSGGQTAYADSVKGRFTISRDNSKNTLYLQMNSLRAEDTAVYYCARVALLLGHAFDIWGQGTMVTVSSASTKG

SEQ ID NO: 45 - DNA, 308 bp, Artificial Sequence
  Synthetically generated oligonucleotide
  CDS (1)...(306)
caagacatccagatgacccagtctccttccaccctgtctgcatctttaggagacagagtcaccatcacttgccgggccagtgagagtattagtaggtggttggcctggtatcagcagaaaccagggaaagcccctaagctcctgatgtatgaggcatccactttagaaagtggggtcccatcaaggttcaccggcactggatctgggacagaattcactctcaccatcagcagcctgcagcccgatgattttgcaacttattactgtcagcagcgtagcaactggcccctcactttcggcggagggac

SEQ ID NO: 46 - protein, 102 aa, Artificial Sequence
  Synthetically generated peptide
QDIQMTQSPSTLSASLGDRVTITCRASESISRWLAWYQQKPGKAPKLLMYEASTLESGVPSRFTGTGSGTEFTLTISSLQPDDFATYYCQQRSNWPLTFGGG

SEQ ID NO: 47 - DNA, 429 bp, Artificial Sequence
  Synthetically generated oligonucleotide
  CDS (1)...(429)
gaagttcaattgttagagtctggtggcggtcttgttcagcctggtggttctttacgtctttcttgcgctgcttccggattcactttctctgcttacatgatgtcttgggttcgccaagctcctggtaaaggtttggagtgggtttcttctatctatccttctggtggctatacttattatgctgactccgttaaaggtcgcttcactatctctagagacaactctaagaatactctctacttgcagatgaacagcttaagggctgaggacactgcagtctactattgtgcgagaggcttacggggaggtcctgactactggggccagggaaccctggtcaccgtctcaagcgcctccaccaagggcccatcggtcttcccgctagcaccctcctccaagagcacctctgggggcacagcggccctgggc

SEQ ID NO: 48 - protein, 143 aa, Artificial Sequence
  Synthetically generated peptide
EVQLLESGGGLVQPGGSLRLSCAASGFTFSAYMMSWVRQAPGKGLEWVSSIYPSGGYTYYADSVKGRFTISRDNSKNTLYLQMNSLRAEDTAVYYCARGLRGGPDYWGQGTLVTVSSASTKGPSVFPLAPSSKSTSGGTAALG

SEQ ID NO: 49 - DNA, 308 bp, Artificial Sequence
  Synthetically generated oligonucleotide
  CDS (1)...(306)
caagacatccagatgacccagtctccttccaccctgtctgcatatgtaggagacagtgtcaccatcacttgccgggccagtcagagtgtgagaaggtcgttggcctggtatcagcagagaccagggaaagcccccaagtccctcatctataaggcgtctactttagagactggggtcccaccaaggttcagcggcagtggatctgggacagaattcactctcaccatcagcagcctgcagcctgaagattctgcaatttattactgccaacaatatggtagttttccgctcactttcggcggagggac

SEQ ID NO: 50 - protein, 102 aa, Artificial Sequence
  Synthetically generated peptide
QDIQMTQSPSTLSAYVGDSVTITCRASQSVRRSLAWYQQRPGKAPKSLIYKASTLETGVPPRFSGSGSGTEFTLTISSLQPEDSAIYYCQQYGSFPLTFGGG

SEQ ID NO: 51 - DNA, 441 bp, Artificial Sequence
  Synthetically generated oligonucleotide
  CDS (1)...(441)
gaagttcaattgttagagtctggtggcggtcttgttcagcctggtggttctttacgtctttcttgcgctgcttccggattcactttctctcattacatgatggtttgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacactgcagtctactattgtgcgaggctggactacggtggtaattccgcctactttgactactggggccagggaaccctggtcaccgtctcaagcgcctccaccaagggcccatcggtcttcccgctagcaccctcctccaagagcacctctgggggcacagcggccctgggc

SEQ ID NO: 52 - protein, 147 aa, Artificial Sequence
  Synthetically generated peptide
EVQLLESGGGLVQPGGSLRLSCAASGFTFSHYMMVWVRQAPGKGLEWVSSIYPSGGWTYYADSVKGRFTISRDNSKNTLYLQMNSLRAEDTAVYYCARLDYGGNSAYFDYWGQGTLVTVSSASTKGPSVFPLAPSSKSTSGGTAALG

SEQ ID NO: 53 - DNA, 327 bp, Artificial Sequence
  Synthetically generated oligonucleotide
  CDS (1)...(327)
cagagcgtcttgactcagccgcactctgtgtcggcctctccggggaagacggtaaccatctcctgcacccgcagcagtggcaacattgccagcaactttgtccagtggtaccaacagcgcccgggcagtgtccccaccactgtgatttatgaagatgaccgaagaccctctggggtccctgatcgcttttctggctccatcgacagttcctccaactctgctttcctcagcatctctggactgaagactgaggacgaggcagactattactgtcagtctcatgatcgtaccacccgtgcttgggtgttcggcggagggaccaagctg

SEQ ID NO: 54 - protein, 109 aa, Artificial Sequence
  Synthetically generated peptide
QSVLTQPHSVSASPGKTVTISCTRSSGNIASNFVQWYQQRPGSVPTTVIYEDDRRPSGVPDRFSGSIDSSSNSAFLSISGLKTEDEADYYCQSHDRTTRAWVFGGGTKL

SEQ ID NO: 55 - DNA, 413 bp, Artificial Sequence
  Synthetically generated oligonucleotide
  CDS (1)...(411)
gaagttcaattgttagagtctggtggcggtcttgttcagcctggtggttctttacgtctttcttgcgctgcttccggattcactttctctcgttacactatgatgtgggttcgccaagctcctggtaaaggtttggagtgggtttctggtatctatccttctggtggcgttactctttatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggcccatcggtcttcccgct

SEQ ID NO: 56 - protein, 137 aa, Artificial Sequence
  Synthetically generated peptide
EVQLLESGGGLVQPGGSLRLSCAASGFTFSRYTMMWVRQAPGKGLEWVSGIYPSGGVTLYADSVKGRFTISRDNSKNTLYLQMNSLRAEDTAVYYCARVNYYDSSGYGPIAPGLDYWGQGTLVTVSSASTKGPSVFP

SEQ ID NO: 57 - DNA, 339 bp, Artificial Sequence
  Synthetically generated oligonucleotide
  CDS (1)...(339)
cacagtgcacaagacatccagatgacccagtctccaggcaccctgtctttgtctccaggggaaagagccacactctcctgcagggccagtcggagtgtgatcatcagctacgtagcctggtaccagcagaaacctggccaggctcccaggctcctcatctatggagcgtccaccagggccactggcatcccagacaggttcagtggcagtgggtctgggacagacttcactctcaccatcagcagactggagcctgaagactttgcagtgtatttctgtcagctttatggtaggtcaccacggatcatcttcggccaagggacacgactggagattaaa

SEQ ID NO: 58 - protein, 113 aa, Artificial Sequence
  Synthetically generated peptide
HSAQDIQMTQSPGTLSLSPGERATLSCRASRSVIISYVAWYQQKPGQAPRLLIYGASTRATGIPDRFSGSGSGTDFTLTISRLEPEDFAVYFCQLYGRSPRIIFGQGTRLEIK

SEQ ID NO: 59 - DNA, 369 bp, Artificial Sequence
  Synthetically generated oligonucleotide
  CDS (1)...(369)
gaagttcaattgttagagtctggtggcggtcttgttcagcctggtggttctttacgtctttcttgcgctgcttccggattcactttctctaattacgttatggtttgggttcgccaagctcctggtaaaggtttggagtgggtttctggtatctatccttctggtggccatactaagtatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtc

SEQ ID NO: 60 - protein, 123 aa, Artificial Sequence
  Synthetically generated peptide
EVQLLESGGGLVQPGGSLRLSCAASGFTFSNYVMVWVRQAPGKGLEWVSGIYPSGGHTKYADSVKGRFTISRDNSKNTLYLQMNSLRAEDTAVYYCARVNYYDSSGYGPIAPGLDYWGQGTLV

SEQ ID NO: 61 - DNA, 339 bp, Artificial Sequence
  Synthetically generated oligonucleotide
  CDS (1)...(339)
cacagtgcacaagacatccagatgacccagtctccaggcaccctgtctttgtctccaggggaaagagccaccctcttctgcagggccagtcagcgtgttaccagcaactccttggcctggtaccagcagagacctggccaggctcccaggctcctcatctatgatgcatccaccagggccactggcatcccagaccgcttcagtggcagtgggtcggggagggacttcactctcaccatcagcagactggagcctgaagattttgcagtttattactgtcagcgatatggtagttcagtgttgtactcttttggccaggggacgaagttggaaatcaca

SEQ ID NO: 62 - protein, 113 aa, Artificial Sequence
  Synthetically generated peptide
HSAQDIQMTQSPGTLSLSPGERATLFCRASQRVTSNSLAWYQQRPGQAPRLLIYDASTRATGIPDRFSGSGSGRDFTLTISRLEPEDFAVYYCQRYGSSVLYSFGQGTKLEIT

SEQ ID NO: 63 - DNA, 383 bp, Artificial Sequence
  Synthetically generated oligonucleotide
  CDS (1)...(381)
gaagttcaattgttagagtctggtggcggtcttgttcagcctggtggttctttacgtctttcttgcgctgcttccggattcactttctctatttacggtatggcttgggttcgccaagctcctggtaaaggtttggagtgggtttctgttatctctccttctggtggccagactttttatgctgactccgttaaaggtcgcttcactatctctagagacaactctaagaatactctctacttgcagatgaacagcttaagggctgaggacactgcagtctactattgtgcgagagtttactactacggtatggacgtctggggccaagggaccacggtcaccgtctcaagcgcctccaccaagggcccatcggtcttcccgct

SEQ ID NO: 64 - protein, 127 aa, Artificial Sequence
  Synthetically generated peptide
EVQLLESGGGLVQPGGSLRLSCAASGFTFSIYGMAWVRQAPGKGLEWVSVISPSGGQTFYADSVKGRFTISRDNSKNTLYLQMNSLRAEDTAVYYCARVYYYGMDVWGQGTTVTVSSASTKGPSVFP

SEQ ID NO: 65 - DNA, 333 bp, Artificial Sequence
  Synthetically generated oligonucleotide
  CDS (1)...(333)
cacagtgcacaagacatccagatgacccagtctccagccaccctgtctttgtctccaggggaaagagccaccctctcctgcagggccagtcagagtgttagcagctacttagcctggtaccaacaaaaacctggccaggctcccaggctcctcatttatgatgcatccaacagggccactggcatcccagccaggttcagtggcagtgggtctgagacagacttcactctcaccatcagcagcctagagcctgaagattttgcagtttattactgtcagcagcgtagcaagtggcctcggacttttggccaggggaccaagctggagatcaaa

SEQ ID NO: 66 - protein, 111 aa, Artificial Sequence
  Synthetically generated peptide
HSAQDIQMTQSPATLSLSPGERATLSCRASQSVSSYLAWYQQKPGQAPRLLIYDASNRATGIPARFSGSGSETDFTLTISSLEPEDFAVYYCQQRSKWPRTFGQGTKLEIK

SEQ ID NO: 67 - DNA, 413 bp, Artificial Sequence
  Synthetically generated oligonucleotide
  CDS (1)...(411)
gaagttcaattgttagagtctggtggcggtcttgttcagcctggtggttctttacgtctttcttgcgctgcttccggattcactttctcttcttacgttatgatgtgggttcgccaagctcctggtaaaggtttggagtgggtttctggtatctatccttctggtggctggacttattatactgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggcccatcggtcttcccgct

SEQ ID NO: 68 - protein, 137 aa, Artificial Sequence
  Synthetically generated peptide
EVQLLESGGGLVQPGGSLRLSCAASGFTFSSYVMMWVRQAPGKGLEWVSGIYPSGGWTYYTDSVKGRFTISRDNSKNTLYLQMNSLRAEDTAVYYCARVNYYDSSGYGPIAPGLDYWGQGTLVTVSSASTKGPSVFP

SEQ ID NO: 69 - DNA, 336 bp, Artificial Sequence
  Synthetically generated oligonucleotide
  CDS (1)...(336)
cacagtgcacaagacatccagatgacccagtctccatcctccctgtctgcatctgttggagatagagtcaccatcacttgccgggcaagtcagagtgtcagcagtcatttaagttggtttcagcagagaccagggaaagcccccaacctcctgatctatcatgcatccagtttgcaaagtggggtcccatcaaggttcagtggcagtgggtctgggacagatttcacgctcaccatcagcagtctgcaacctgaagattttgcaacttactactgtcagcagagttacgctacttcctcgatcaccttcggccaggggacacgactggacattaaa

SEQ ID NO: 70 - protein, 112 aa, Artificial Sequence
  Synthetically generated peptide
HSAQDIQMTQSPSSLSASVGDRVTITCRASQSVSSHLSWFQQRPGKAPNLLIYHASSLQSGVPSRFSGSGSGTDFTLTISSLQPEDFATYYCQQSYATSSITFGQGTRLDIK

SEQ ID NO: 71 - DNA, 413 bp, Artificial Sequence
  Synthetically generated oligonucleotide
  CDS (1)...(411)
gaagttcaattgttagagtctggtggcggtcttgttcagcctggtggttctttacgtctttcttgcgctgcttccggattcactttctctcgttacaagatgaagtgggttcgccaagctcctggtaaaggtttggagtgggtttctgttatctatccttctggtggcggtactggttatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggcccatcggtcttcccgct

SEQ ID NO: 72 - protein, 137 aa, Artificial Sequence
  Synthetically generated peptide
EVQLLESGGGLVQPGGSLRLSCAASGFTFSRYKMKWVRQAPGKGLEWVSVIYPSGGGTGYADSVKGRFTISRDNSKNTLYLQMNSLRAEDTAVYYCARVNYYDSSGYGPIAPGLDYWGQGTLVTVSSASTKGPSVFP

SEQ ID NO: 73 - DNA, 428 bp, Artificial Sequence
  Synthetically generated oligonucleotide
  CDS (1)...(426)
cacagtgcacagagcgtcttgactcagcctgactccgtgtctgggtctcctggagagtcgatcaccatctcctgcactggaagcagcagagacgttggtggttataactatgtctcctggtaccaacaacacccaggcaaagcccccaaactcttgctttatgatgtcacttatcggccctcagggatttctggtcgcttctctggctccaagtctggcgacacggcctccctgaccatctctgggctccggactgaggacgaggctgattattactgcagctcatctataggcaccaggacttatgtcttcggaagtgggaccaaggtcaccgtcctacgtcagcccaaggccaaccccactgtcactctgttcccgccctcctctgaggagctccaagccaacaaggccacactagtgtgtctgat

SEQ ID NO: 74 - protein, 142 aa, Artificial Sequence
  Synthetically generated peptide
HSAQSVLTQPDSVSGSPGESITISCTGSSRDVGGYNYVSWYQQHPGKAPKLLLYDVTYRPSGISGRFSGSKSGDTASLTISGLRTEDEADYYCSSSIGTRTYVFGSGTKVTVLRQPKANPTVTLFPPSSEELQANKATLVCL

SEQ ID NO: 75 - DNA, 386 bp, Artificial Sequence
  Synthetically generated oligonucleotide
  CDS (1)...(384)
gaagttcaattgttagagtctggtggcggtcttgttcagcctggtggttctttacgtctttcttgcgctgcttccggattcactttctctcgttacgttatgtattgggttcgccaagctcctggtaaaggtttggagtgggtttctgttatctatccttctggtggcgctacttattatgctgactccgttaaaggtcgcttcactatctctagagacaactctaagaatactctctacttgcagatgaacagcttaagggctgaggacactgcagtctactattgtgcgagacggggaagtagtggtgcgtttgactactggggccagggaaccctggtcaccgtctcaagcgcctccaccaagggcccatcggtcttcccgct

SEQ ID NO: 76 - protein, 128 aa, Artificial Sequence
  Synthetically generated peptide
EVQLLESGGGLVQPGGSLRLSCAASGFTFSRYVMYWVRQAPGKGLEWVSVIYPSGGATYYADSVKGRFTISRDNSKNTLYLQMNSLRAEDTAVYYCARRGSSGAFDYWGQGTLVTVSSASTKGPSVFP

SEQ ID NO: 77 - DNA, 434 bp, Artificial Sequence
  Synthetically generated oligonucleotide
  CDS (1)...(432)
cacagtgcacagagcgtcttgactcagcctgcctccgtgtctgggtctcctggacagtcgatcaccatctcctgcactggaaccagcagtgacattggtcgttataactatgcctcctggtaccaacaacgcccaggcaaatcccccaaactcctgatttatgaggtcagtgatcggccctcaggggtttctaatcgcttctctggctccaagtctggcaacacggcctccctgatcatctctgggctccaggctgaggacgaggctgattattactgcagctcatattcaagcaccaacagtctccaagtggtattcggcggagggaccaagctgagcgtcctaggtcagcccaaggctgccccctcggtcactctgttcccgccctcctctgaggagcttcaagccaacaaggccacactggtgtgtctcat

SEQ ID NO: 78 - protein, 144 aa, Artificial Sequence
  Synthetically generated peptide
HSAQSVLTQPASVSGSPGQSITISCTGTSSDIGRYNYASWYQQRPGKSPKLLIYEVSDRPSGVSNRFSGSKSGNTASLIISGLQAEDEADYYCSSYSSTNSLQVVFGGGTKLSVLGQPKAAPSVTLFPPSSEELQANKATLVCL

SEQ ID NO: 79 - DNA, 413 bp, Artificial Sequence
  Synthetically generated oligonucleotide
  CDS (1)...(411)
gaagttcaattgttagagtctggtggcggtcttgttcagcctggtggttctttacgtctttcttgcgctgcttccggattcactttctctgcttacggtatgtcttgggttcgccaagctcctggtaaaggtttggagtgggtttctgttatctatccttctggtggctggacttattatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggcccatcggtcttcccgct

SEQ ID NO: 80 - protein, 137 aa, Artificial Sequence
  Synthetically generated peptide
EVQLLESGGGLVQPGGSLRLSCAASGFTFSAYGMSWVRQAPGKGLEWVSVIYPSGGWTYYADSVKGRFTISRDNSKNTLYLQMNSLRAEDTAVYYCARVNYYDSSGYGPIAPGLDYWGQGTLVTVSSASTKGPSVFP

SEQ ID NO: 81 - DNA, 336 bp, Artificial Sequence
  Synthetically generated oligonucleotide
  CDS (1)...(336)
cacagtgcacaagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtataataactggcctcggacgttcggccaagggaccaaggtggaaatcaaa

SEQ ID NO: 82 - protein, 112 aa, Artificial Sequence
  Synthetically generated peptide
HSAQDIQMTQSPGTLSLSPGERATLSCRASQSVSSSYLAWYQQKPGQAPRLLIYGASSRATGIPDRFSGSGSGTDFTLTISRLEPEDFAVYYCQQYNNWPRTFGQGTKVEIK

SEQ ID NO: 83 - DNA, 395 bp, Artificial Sequence
  Synthetically generated oligonucleotide
  CDS (1)...(393)
gaagttcaattgttagagtctggtggcggtcttgttcagcctggtggttctttacgtctttcttgcgctgcttccggattcactttctctggttacgctatgtggtgggttcgccaagctcctggtaaaggtttggagtgggtttcttctatctctccttctggtggcgctactgcttatgctgactccgttaaaggtcgcttcactatctctagagacaactctaagaatactctctacttgcagatgaacagcttaagggctgaggacactgcagtctactattgtgcgagagatgcggggagttattattggggctggttcgacccctggggccagggaaccctggtcaccgtctcaagcgcctccaccaagggcccatcggtcttcccgct

SEQ ID NO: 84 - protein, 131 aa, Artificial Sequence
  Synthetically generated peptide
EVQLLESGGGLVQPGGSLRLSCAASGFTFSGYAMWWVRQAPGKGLEWVSSISPSGGATAYADSVKGRFTISRDNSKNTLYLQMNSLRAEDTAVYYCARDAGSYYWGWFDPWGQGTLVTVSSASTKGPSVFP

SEQ ID NO: 85 - DNA, 333 bp, Artificial Sequence
  Synthetically generated oligonucleotide
  CDS (1)...(333)
cacagtgcacaagacatccagatgacccagtctccagccaccttgtctttgtctccaggggaaagagccaccctctcctgcagggccagtcagagtattagcagctacttagcctggtaccaacagaaacctggccagcctcccaggctcctcatctatgatgcatccagcagggttactggcatcccagccaggttcagtggcagtggctttgggacagacttcactctcaccattagtagcctggagcctgaagattttgcagtttattactgtctccagcgtagcagctggccccgaacttttggccaggggaccaagctggagatcaaa

SEQ ID NO: 86 - protein, 111 aa, Artificial Sequence
  Synthetically generated peptide
HSAQDIQMTQSPATLSLSPGERATLSCRASQSISSYLAWYQQKPGQPPRLLIYDASSRVTGIPARFSGSGFGTDFTLTISSLEPEDFAVYYCLQRSSWPRTFGQGTKLEIK

SEQ ID NO: 87 - DNA, 413 bp, Artificial Sequence
  Synthetically generated oligonucleotide
  CDS (1)...(411)
gaagttcaattgttagagtctggtggcggtcttgttcagcctggtggttctttacgtctttcttgcgctgcttccggattcactttctctggttacgttatgttttgggttcgccaagctcctggtaaaggtttggagtgggtttctggtatctatccttctggtggctggactgtttatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggcccatcggtcttcccgct

SEQ ID NO: 88 - protein, 137 aa, Artificial Sequence
  Synthetically generated peptide
EVQLLESGGGLVQPGGSLRLSCAASGFTFSGYVMFWVRQAPGKGLEWVSGIYPSGGWTVYADSVKGRFTISRDNSKNTLYLQMNSLRAEDTAVYYCARVNYYDSSGYGPIAPGLDYWGQGTLVTVSSASTKGPSVFP

SEQ ID NO: 89 - DNA, 333 bp, Artificial Sequence
  Synthetically generated oligonucleotide
  CDS (1)...(333)
cacagtgcacaagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcaatatggtagctcacggacgttcggccaagggaccaacgtggaaatcaaa

SEQ ID NO: 90 - protein, 111 aa, Artificial Sequence
  Synthetically generated peptide
HSAQDIQMTQSPGTLSLSPGERATLSCRASQSVSSSYLAWYQQKPGQAPRLLIYGASSRATGIPDRFSGSGSGTDFTLTISRLEPEDFAVYYCQQYGSSRTFGQGTNVEIK

SEQ ID NO: 91 - DNA, 395 bp, Artificial Sequence
  Synthetically generated oligonucleotide
  CDS (1)...(393)
gaagttcaattgttagagtctggtggcggtcttgttcagcctggtggttctttacgtctttcttgcgctgcttccggattcactttctcttcttacatgatgacttgggttcgccaagctcctggtaaaggtttggagtgggtttcttctatctatccttctggtggctatacttattatgctgactccgttaaaggtcgcttcactatctctagagacaactctaagaatactctctacttgcagatgaacagcttaagggctgaggacactgcagtctactattgtgcgagaggagggtatggcgactcgtcatttttttttgactactggggccagggaaccctggtcaccgtctcaagcgcctccaccaagggcccatcggtcttcccgct

SEQ ID NO: 92 - protein, 131 aa, Artificial Sequence
  Synthetically generated peptide
EVQLLESGGGLVQPGGSLRLSCAASGFTFSSYMMTWVRQAPGKGLEWVSSIYPSGGYTYYADSVKGRFTISRDNSKNTLYLQMNSLRAEDTAVYYCARGGYGDSSFFFDYWGQGTLVTVSSASTKGPSVFP

SEQ ID NO: 93 - DNA, 333 bp, Artificial Sequence
  Synthetically generated oligonucleotide
  CDS (1)...(333)
cacagtgcacaagacatccagatgacccagtctccagccaccctgtctgtgtctccaggggaaggagccaccctctcttgcagggccagtcggagtgttggcagcaacttagcctggtaccagcagaagcctggccaggctcccaggctcctcatctatgatgcatccaccagggccactggtatccccgccaggttcagtggcagtgggtctgggacaaagttcactctcaccatcagcagcctccagtctgaagattttgcagtttattactgtcagcagcgtagcaattggcctctcactttcggcggagggaccaaggtggagatcaaa

SEQ ID NO: 94 - protein, 111 aa, Artificial Sequence
  Synthetically generated peptide
HSAQDIQMTQSPATLSVSPGEGATLSCRASRSVGSNLAWYQQKPGQAPRLLIYDASTRATGIPARFSGSGSGTKFTLTISSLQSEDFAVYYCQQRSNWPLTFGGGTKVEIK

SEQ ID NO: 95 - DNA, 428 bp, Artificial Sequence
  Synthetically generated oligonucleotide
  CDS (1)...(426)
cacagtgcacagagcgtcttgactcagcctgcctccgtgtctgggtctcctggacagtcgatcaccatctcctgcactggaaccagcagtgacgttggtgatgataactatgtctcctggtaccaacaacacccagacaaagcccccaaactcatgatttatgaggtcagttatcggccctcaggggtttctaatcgcttctctggctccaagtctggcaacacggcctccctgaccatctctgggctccagactgaggacgaggctgattattattgcggctcatatcgcgtcagcagctcctatgtcttcggaactgggaccaaggtcaccgtcctaggtcagcccaaggccaaccccactgtcactctgttcccgccctcctctgaggagctccaagccaacaaggccacactagtgtgtctgat

SEQ ID NO: 96 - protein, 142 aa, Artificial Sequence
  Synthetically generated peptide
HSAQSVLTQPASVSGSPGQSITISCTGTSSDVGDDNYVSWYQQHPDKAPKLMIYEVSYRPSGVSNRFSGSKSGNTASLTISGLQTEDEADYYCGSYRVSSSYVFGTGTKVTVLGQPKANPTVTLFPPSSEELQANKATLVCL

SEQ ID NO: 97 - DNA, 363 bp, Artificial Sequence
  Synthetically generated oligonucleotide
  CDS (1)...(363)
gaagttcaattgttagagtctggtggcggtcttgttcagcctggtggttctttacgtctttcttgcgctgcttccggattcactttctctcgttacaagatgttttgggttcgccaagctcctggtaaaggtttggagtgggtttctgttatctatccttctggtggccctactatgtatgctgactccgttaaaggtcgcttcactatctctagagacaactctaagaatactctctacttgcagatgaacagcttaagggctgaggacactgcagtctactattgtgcgagagggatggtccgtggatatagtggctacgattaccctttcttggactactggggccagggaaccctggtc

SEQ ID NO: 98 - protein, 121 aa, Artificial Sequence
  Synthetically generated peptide
EVQLLESGGGLVQPGGSLRLSCAASGFTFSRYKMFWVRQAPGKGLEWVSVIYPSGGPTMYADSVKGRFTISRDNSKNTLYLQMNSLRAEDTAVYYCARGMVRGYSGYDYPFLDYWGQGTLV

SEQ ID NO: 99 - DNA, 333 bp, Artificial Sequence
  Synthetically generated oligonucleotide
  CDS (1)...(333)
cacagtgcacaagacatccagatgacccagtctccatcttccctgtctgcatctgtaggggacagagtcaccatcacttgccgagcaagtcagaccattagcagctatttaaattggtatcagcagaagccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcgtacgttcggccaagggaccaaggtggaaatcaaa

SEQ ID NO: 100 - protein, 111 aa, Artificial Sequence
  Synthetically generated peptide
HSAQDIQMTQSPSSLSASVGDRVTITCRASQTISSYLNWYQQKPGKAPKLLIYAASSLQSGVPSRFSGSGSGTDFTLTISSLQPEDFATYYCQQSYSTPRTFGQGTKVEIK

SEQ ID NO: 101 - DNA, 386 bp, Artificial Sequence
  Synthetically generated oligonucleotide
  CDS (1)...(384)
gaagttcaattgttagagtctggtggcggtcttgttcagcctggtggttctttacgtctttcttgcgctgcttccggattcactttctctgcttaccagatggtttgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacactgcagtctactattgtgcgagaggcacgcacctcccgggggttgactactggggccagggaaccctggtcaccgtctcaagcgcctccaccaagggcccatcggtcttcccgct

SEQ ID NO: 102 - protein, 128 aa, Artificial Sequence
  Synthetically generated peptide
EVQLLESGGGLVQPGGSLRLSCAASGFTFSAYQMVWVRQAPGKGLEWVSSIYPSGGWTYYADSVKGRFTISRDNSKNTLYLQMNSLRAEDTAVYYCARGTHLPGVDYWGQGTLVTVSSASTKGPSVFP

SEQ ID NO: 103 - DNA, 339 bp, Artificial Sequence
  Synthetically generated oligonucleotide
  CDS (1)...(339)
cacagtgcacaagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcccccatgtacacttttggccaggggaccaagctggagatcaaa

SEQ ID NO: 104 - protein, 113 aa, Artificial Sequence
  Synthetically generated peptide
HSAQDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPMYTFGQGTKLEIK

SEQ ID NO: 105 - DNA, 339 bp, Artificial Sequence
  Synthetically generated oligonucleotide
  CDS (1)...(339)
gaagttcaattgttagagtctggtggcggtcttgttcagcctggtggttctttacgtctttcttgcgctgcttccggattcactttctcttcttacaagatgggttgggttcgccaagctcctggtaaaggtttggagtgggtttcttctatctatccttctggtggctggactcattatgctgactccgttaaaggtcgcttcactatctctagagacaactctaagaatactctctacttgcagatgaacagcttaagggctgaggacactgcagtctactattgtgcaagagtactactacactactttgactactggggccagggaaccctggtc

SEQ ID NO: 106 - protein, 113 aa, Artificial Sequence
  Synthetically generated peptide
EVQLLESGGGLVQPGGSLRLSCAASGFTFSSYKMGWVRQAPGKGLEWVSSIYPSGGWTHYADSVKGRFTISRDNSKNTLYLQMNSLRAEDTAVYYCARVLLHYFDYWGQGTLV

SEQ ID NO: 107 - DNA, 415 bp, Artificial Sequence
  Synthetically generated oligonucleotide
  CDS (1)...(414)
cacagtgcacagagcgtcttgactcagcctgcctccgtgtctgggtctcctggacagtcgatcaccatctcctgcactggaaccagcagtgacgttggtggttataaatatgtctcctggtaccaacagcacccaggcaaagcccccaaactcattatttctgacgtcaataatcggccctcaggggtttctgatcgcttctctggctccaagtctggcaacacggcctccctgaccatctctgggctccaggctgaggacgacggtgattattactgcagttcctacgcaagtagttcctatacaagcagtaccacttgggtgttcggcggggggaccaagctgaccgtcctaggtcagcccaaggctgcccccttggtcactctgttcccaccctcctctgaggagcttcaag

SEQ ID NO: 108 - protein, 138 aa, Artificial Sequence
  Synthetically generated peptide
HSAQSVLTQPASVSGSPGQSITISCTGTSSDVGGYKYVSWYQQHPGKAPKLIISDVNNRPSGVSDRFSGSKSGNTASLTISGLQAEDDGDYYCSSYASSSYTSSTTWVFGGGTKLTVLGQPKAAPLVTLFPPSSEELQ

SEQ ID NO: 109 - DNA, 471 bp, Artificial Sequence
  Synthetically generated oligonucleotide
  CDS (1)...(471)
gaagttcaattgttagagtctggtggcggtcttgttcagcctggtggttctttacgtctttcttgcgctgcttccggattcactttctcttcttacaagatgggttgggttcgccaagctcctggtagaggtttggagtgggtttcttctatctatccttctggtggctggactcattatgctgactccgttaaaggtcgcttcactatctctagagacaactctaagaatactctctacttgcagatgaacagcttaagggctgaggacactgcagtctactattgtgcaagagtactactacactactttgactactggggccagggaaccctggtcaccgtctcaagcgcctccaccaagggcccatcggtcttccccctggcaccctcctccaagagcacctcgggggcacagcggccctgggctgcctggtcaaggactacttcccgcgataccggtgacggtgtc

SEQ ID NO: 110 - protein, 157 aa, Artificial Sequence
  Synthetically generated peptide
EVQLLESGGGLVQPGGSLRLSCAASGFTFSSYKMGWVRQAPGRGLEWVSSIYPSGGWTHYADSVKGRFTISRDNSKNTLYLQMNSLRAEDTAVYYCARVLLHYFDYWGQGTLVTVSSASTKGPSVFPLAPSSKSTSGAQRPWAAWSRTTSRDTGDGV

SEQ ID NO: 111 - DNA, 325 bp, Artificial Sequence
  Synthetically generated oligonucleotide
  CDS (1)...(324)
cagagcgtcttgactcagcctgcctccgtgtctgggtctcctggacagtcgatcaccatctcctgcactggaaccagcagtgacgttggtggttataaatatgtctcctggtaccaacagcacccaggcaaagcccccaaactcattatttctgacgtcaataatcggccctcaggggtttctgatcgcttctctggctccaagtctggcaacacggcctccctgaccatctctgggctccaggctgaggacgacggtgattattactgcagttcctacgcaagtagttcctatacaagcagtaccacttgggtgttcggcgggg

SEQ ID NO: 112 - protein, 108 aa, Artificial Sequence
  Synthetically generated peptide
QSVLTQPASVSGSPGQSITISCTGTSSDVGGYKYVSWYQQHPGKAPKLIISDVNNRPSGVSDRFSGSKSGNTASLTISGLQAEDDGDYYCSSYASSSYTSSTTWVFGG

SEQ ID NO: 113 - DNA, 425 bp, Artificial Sequence
  Synthetically generated oligonucleotide
  CDS (1)...(423)
gaagttcaattgttagagtctggtggcggtcttgttcagcctggtggttctttacgtctttcttgcgctgcttccggattcactttctctatgtacggtatggtttgggttcgccaagctcctggtaaaggtttggagtgggtttctgttatctctccttctggtggcaatactggttatgctgactccgttaaaggtcgcttcactatctctagagacaactctaagaatactctctacttgcaggtgaacagcttaagggctgaggacactgcagtctactattgtgcgagagccccacgtggatacagctatggttactactactggggccagggaaccctggtcaccgtctcaagcgcctccaccaagggcccatcggtcttcccgctagcaccctcctccaagagcacctctgggggcac

SEQ ID NO: 114 - protein, 141 aa, Artificial Sequence
  Synthetically generated peptide
EVQLLESGGGLVQPGGSLRLSCAASGFTFSMYGMVWVRQAPGKGLEWVSVISPSGGNTGYADSVKGRFTISRDNSKNTLYLQVNSLRAEDTAVYYCARAPRGYSYGYYYWGQGTLVTVSSASTKGPSVFPLAPSSKSTSGG

SEQ ID NO: 115 - DNA, 322 bp, Artificial Sequence
  Synthetically generated oligonucleotide
  CDS (1)...(321)
gacatccagatgacccagtctccactctccctgtctgcatctgtaggagacagagtcaccatcacttgccgggcgagtcagggcattggccattatttagcctggtatcagcagaaaccagggaaagttcctaagctcctgatctatactgcatccactttgcaatcaggggtcccatctcggttcagtggcagtggatctgggacagatttcactctcaccatcaacagcctgcagcctgaggatgttgcaacttattactgtcaacagtttaatagttaccctcacaccttcggccaagggacacgactggatattaaac

SEQ ID NO: 116 - protein, 107 aa, Artificial Sequence
  Synthetically generated peptide
DIQMTQSPLSLSASVGDRVTITCRASQGIGHYLAWYQQKPGKVPKLLIYTASTLQSGVPSRFSGSGSGTDFTLTINSLQPEDVATYYCQQFNSYPHTFGQGTRLDIK

SEQ ID NO: 117 - protein, 5 aa, Artificial Sequence
  Synthetically generated peptide
  VARIANT 1: Xaa = Ala, Gly, Ser, Arg
  VARIANT 3: Xaa = Gly, Val, Lys
  VARIANT 5: Xaa = Gly, Ser, Val, Phe
XYXMX

SEQ ID NO: 118 - protein, 5 aa, Artificial Sequence
  Synthetically generated peptide
  VARIANT 1: Xaa = Ala, Gly, Ser, Ile, Met, Arg, His
  VARIANT 3: Xaa = Gly, Val, Met, Lys
  VARIANT 5: Xaa = Gly, Ser, Val, Met, Phe, His
XYXMX

SEQ ID NO: 119 - protein, 5 aa, Artificial Sequence
  Synthetically generated peptide
  VARIANT 1: Xaa = Ala, Gly, Ser, Ile, Met, Arg, Asn, His
  VARIANT 3: Ala, Gly, Thr, Val, Met, Lys, Pro, Gln
  VARIANT 5: Xaa = Ala, Gly, Ser, Thr, Val, Met, Tyr, Trp, Phe, Lys, His
XYXMX

SEQ ID NO: 120 - protein, 17 aa, Artificial Sequence
  Synthetically generated peptide
  VARIANT 1, 8, 10: Xaa = any amino acid
XIYPSGGXTXYADSVKG

SEQ ID NO: 121 - protein, 10 aa, Artificial Sequence
  Synthetically generated peptide
  VARIANT 1: Xaa = Gly, Ser, Val
  VARIANT 3: Xaa = Ser, Tyr
  VARIANT 8: Xaa = Trp, Gln
  VARIANT 10: Xaa = Gly, Tyr
XIXPSGGXTX

SEQ ID NO: 122 - protein, 17 aa, Artificial Sequence
  Synthetically generated peptide
  VARIANT 1: Xaa = Gly, Ser, Val, Trp
  VARIANT 3: Xaa = Ser, Tyr
  VARIANT 8: Xaa = Trp, Gln
  VARIANT 10: Xaa = Gly, Tyr
XIXPSGGXTXYADSVKG

SEQ ID NO: 123 - protein, 10 aa, Artificial Sequence
  Synthetically generated peptide
  VARIANT 1: Xaa = Gly, Ser, Val, Trp
  VARIANT 3: Xaa = Ser, Tyr
  VARIANT 8: Xaa = Ala, Gly, val, Met, Tyr, Trp, Pro, Gln, His
  VARIANT 10: Xaa = Ala, Gly, Ser, Thr, Leu, Val, Met, Tyr, Phe, Lys, His
XIXPSGGXTX

SEQ ID NO: 124 - protein, 5 aa, Artificial Sequence
  Synthetically generated peptide
  VARIANT 2: Xaa = four or five residues
  VARIANT 5: Xaa = Ile or Tyr
VXFDX

SEQ ID NO: 125 - protein, 11 aa, Artificial Sequence
  Synthetically generated peptide
GYGPIAPGLDY

SEQ ID NO: 126 - protein, 18 aa, Artificial Sequence
  Synthetically generated peptide
  VARIANT 1: Xaa = Gly, Val
  VARIANT 5: Xaa = Gly, Tyr, Asp
  VARIANT 7: Xaa = Ser, Asp
XNYYXSXGYGPIAPGLDY

SEQ ID NO: 127 - protein, 18 aa, Artificial Sequence
  Synthetically generated peptide
  VARIANT 1: Xaa = Gly, Val, Asp
  VARIANT 2: Xaa = Ala, Gly, Leu, Asn
  VARIANT 3: Xaa = Leu, Tyr, Arg
  VARIANT 4: Xaa = Gly, Ser, Thr, Leu, Tyr, His
  VARIANT 5: Xaa = Gly, Tyr, Asp
  VARIANT 6: Xaa = Ala, Gly, Ser, Tyr, Phe, Pro
  VARIANT 7: Xaa = Ser, Phe, Asp
  VARIANT 8: Xaa = Ala, Gly, Tyr, Asp
  VARIANT 9: Xaa = Ile, Tyr
  VARIANT 10: Xaa = Gly, Phe, Asp
  VARIANT 11: Xaa = Tyr, Asp, pro
  VARIANT 12: Xaa = Ile, Pro
XXXXXXXXXXXXAPGLDY

SEQ ID NO: 128 - protein, 18 aa, Artificial Sequence
  Synthetically generated peptide
VNYYDSSGYGPIAPGLDY

SEQ ID NO: 129 - protein, 12 aa, Artificial Sequence
  Synthetically generated peptide
  VARIANT 6: Xaa = Ile, Val
  VARIANT 8: Xaa = Ser, Arg
  VARIANT 9: Xaa = Ser, or absent
  VARIANT 12: Xaa = Ala, Asn
RASQSXSXXYLX

SEQ ID NO: 130 - protein, 10 aa, Artificial Sequence
  Synthetically generated peptide
  VARIANT 9: Xaa = any amino acid
RASQSVSSXL

SEQ ID NO: 131 - protein, 11 aa, Artificial Sequence
  Synthetically generated peptide
  VARIANT 6: Xaa = Ile, Val
  VARIANT 8: Xaa = Ser, Arg
  VARIANT 9: Xaa = Ser, Tyr
  VARIANT 10: Xaa  = Leu, Tyr
  VARIANT 11: Xaa = Ala, Leu, Asn
RASQSXSXXXX

SEQ ID NO: 132 - protein, 12 aa, Artificial Sequence
  Synthetically generated peptide
  VARIANT 4: Xaa = Arg, Glu, Gln
  VARIANT 5: Xaa = Gly, Ser, Thr, Arg, Asn
  VARIANT 6: Xaa = Ile, Val
  VARIANT 7: Xaa = gly, Ser, Thr, Ile, Arg, Asn
  VARIANT 8: Xaa = Ser, Thr, Ile, Arg, His
  VARIANT 9: Xaa = Ser, or absent
  VARIANT 10: Xaa = Ser, Tyr, trp, Asn, his
  VARIANT 11: Xaa = Leu, Val
  VARIANT 12: Xaa = Ala, Ser, Asn
RASXXXXXXXXX

SEQ ID NO: 133 - protein, 7 aa, Artificial Sequence
  Synthetically generated peptide
  VARIANT 1, 4: Xaa = any amino acid
XASXRAT

SEQ ID NO: 134 - protein, 7 aa, Artificial Sequence
  Synthetically generated peptide
  VARIANT 1: Xaa = Ala, gly, Asp
  VARIANT 4: Xaa = Ser, Thr, Asn
XASXRAT

SEQ ID NO: 135 - protein, 7 aa, Artificial Sequence
  Synthetically generated peptide
  VARIANT 1: Xaa = Ala, Gly, Asp
  VARIANT 4: Xaa =Ser, Thr, Asn
  VARIANT 5: Xaa = Leu, Arg
  VARIANT 6: Xaa = Ala, glu, Gln
  VARIANT 7: Xaa = Ser, Thr
XASXXXX

SEQ ID NO: 136 - protein, 7 aa, Artificial Sequence
  Synthetically generated peptide
  VARIANT 1: Xaa = Ala, Gly, Thr, Lys, Asp, Glu, His
  VARIANT 4: Xaa = Ser, Thr, Asn
  VARIANT 5: Xaa =Leu, Arg
  VARIANT 6: Xaa = Ala, Val, Glu, Gln
  VARIANT 7: Xaa = Ser, Thr
XASXXXX

SEQ ID NO: 137 - protein, 10 aa, Artificial Sequence
  Synthetically generated peptide
  VARIANT 3: Xaa = Ser, Tyr, Phe, Arg
  VARIANT 4: Xaa = Gly, Ser, Tyr, Asn
  VARIANT 6: Xaa = Ser, Thr, Tyr, Trp
  VARIANT 7: Xaa = Arg, Pro
  VARIANT 8: Xaa = Leu, Trp, Arg
  VARIANT 9: Xaa = Thr, Ile, Tyr
QQXXSXXXXT

SEQ ID NO: 138 - protein, 10 aa, Artificial Sequence
  Synthetically generated peptide
  VARIANT 1: Xaa = Leu, Gln
  VARIANT 3: Xaa = Ser, Tyr, Phe, Arg
  VARIANT 4: Xaa =Gly, Ser, Tyr, Asn
  VARIANT 5: Xaa = Ser, Lys, Asn
  VARIANT 6: Xaa = Ser, Thr, Tyr, Trp
  VARIANT 7: Xaa = Arg, Pro
  VARIANT 8: Xaa = Leu, Trp, Arg
  VARIANT 9: Xaa = Thr, Ile, Tyr
XQXXXXXXXT

SEQ ID NO: 139 - protein, 10 aa, Artificial Sequence
  Synthetically generated peptide
  VARIANT 3: Xaa = Tyr, Arg
  VARIANT 4: Xaa =Gly, Ser
  VARIANT 6: Xaa = Ser, Trp
  VARIANT 9: Xaa = any amino acid or absent
QQXXSXPRXT

SEQ ID NO: 140 - protein, 10 aa, Artificial Sequence
  Synthetically generated peptide
  VARIANT 1, 2: Xaa = Leu, Gln
  VARIANT 3: Xaa =Ser, Tyr, Phe, Arg, Asp
  VARIANT 4: Xaa = Gly, Ser, Tyr, Asn
  VARIANT 5: Xaa = Ser, Thr, Arg, Lys, Asn
  VARIANT 6: Xaa = Ser, Thr, Tyr, Trp, Phe
  VARIANT 7: Xaa = Arg, Pro
  VARIANT 8: Xaa = Ile, Leu, Met, Trp, Arg, His
  VARIANT 9: Xaa = thr, Ile, Tyr
  VARIANT 10: Xaa = Thr, Ile
XXXXXXXXXX

SEQ ID NO: 141 - protein, 10 aa, Artificial Sequence
  Synthetically generated peptide
  VARIANT 1: Xaa = Leu, Gln
  VARIANT 2: Xaa = leu, Arg, Gln
  VARIANT 3: Xaa = Ser, Tyr, Phe, Arg, Asp
  VARIANT 4: Xaa = gly, ser, Tyr, Asn
  VARIANT 5: Xaa = Ala, Ser, Thr, Arg, Lys, Asn
  VARIANT 6: Xaa = Ser, Thr, Tyr, Trp, Phe
  VARIANT 7: Xaa = Ser, Val, Arg, Pro
  VARIANT 8: Xaa = Ser, Thr, Ile, leu, Met, Trp, Arg, His
  VARIANT 9: Xaa = Tyr, Ile, Tyr
  VARIANT 10: Xaa = Ser, thr, Ile
XXXXXXXXXX

SEQ ID NO: 142 - protein, 8 aa, Artificial Sequence
  Synthetically generated peptide
  VARIANT 2: Xaa = any amino acid
  VARIANT 3: Xaa = Asn, Asp
  VARIANT 4: Xaa = Ile, Val
  VARIANT 5: Xaa = Ala, Gly
  VARIANT 6: Xaa = any amino acid (e.g., Gly or Arg)
  VARIANT 7: Xaa = any amino acid (e.g., Tyr or Asn)
  VARIANT 8: Xaa = any amino acid (e.g., Phe, Asn, or Lys)
SXXXXXXX

SEQ ID NO: 143 - protein, 14 aa, Artificial Sequence
  Synthetically generated peptide
  VARIANT 2: Xaa = Gly, Arg
  VARIANT 3: Xaa = Ser, Thr
  VARIANT 5: Xaa = any amino acid
  VARIANT 6: Xaa = Asn, Asp
  VARIANT 7: Xaa = Ile, Val
  VARIANT 8: Xaa = Ala, Gly
  VARIANT 9: Xaa = any amino acid (e.g., Gly or Arg)
  VARIANT 10: Xaa = any amino acid (e.g., Tyr or Asn)
  VARIANT 11: Xaa = any amino acid (e.g., Phe, Asn, or Lys)
  VARIANT 13: Xaa = any amino acid (e.g., aliphatic, e.g., Val or Ala)
TXXSXXXXXXXYXS

SEQ ID NO: 144 - protein, 7 aa, Artificial Sequence
  Synthetically generated peptide
  VARIANT 1: Xaa = Asp, Glu
XVNNRPS

SEQ ID NO: 145 - protein, 7 aa, Artificial Sequence
  Synthetically generated peptide
  VARIANT 1: Xaa = Asp, Glu
  VARIANT 2: Xaa = Val, Asp
  VARIANT 3: Xaa = Ser, Thr, Asp, Asn
  VARIANT 4: Xaa = Tyr, Arg, Asn,p, Asn
XXXXRPS

SEQ ID NO: 146 - protein, 10 aa, Artificial Sequence
  Synthetically generated peptide
  VARIANT 1: Xaa = Ser, Gln
  VARIANT 3: Xaa = Ser, Tyr
  VARIANT 4: Xaa = Ala, Ser, Ile, Asp
  VARIANT 5: Xaa = Gly, Ser, Arg
  VARIANT 6: Xaa = Ser, Thr
  VARIANT 7: Xaa = Ser, Thr, Arg, Asn
  VARIANT 8: Xaa = ser, Thr, Tyr, Arg
  VARIANT 9: Xaa = Ala, Thr, Leu, Tyr
  VARIANT 10: Xaa = Ser, Val, Trp, Gln
XSXXXXXXXX

SEQ ID NO: 147 - protein, 17 aa, Artificial Sequence
  Synthetically generated peptide
  VARIANT 1: Xaa = Gly, Ser, Val, Trp
  VARIANT 3: Xaa = Ser, Tyr
  VARIANT 8: Xaa = Ala, Gly, Val, Met, Tyr, Trp, Pro, Gln, His
  VARIANT 10: Xaa = Ala, Gly, Ser, Thr, Leu, Val, Met, Tyr, Phe, Lys, His
  VARIANT 12: Xaa = Ala, Thr
XIXPSGGXTXYXDSVKG

SEQ ID NO: 148 - protein, 17 aa, Artificial Sequence
  Synthetically generated peptide
  VARIANT 1: Xaa = Gly, Ser, Val
  VARIANT 3: Xaa = Ser, Tyr
  VARIANT 8: Xaa = Trp, Gln
  VARIANT 10: Xaa = Gly, Tyr
  VARIANT 12: Xaa = Ala, Thr
XIXPSGGXTXYXDSVKG

SEQ ID NO: 149 - protein, 4 aa, Artificial Sequence
  Synthetically generated peptide
MYGM

SEQ ID NO: 150 - protein, 18 aa, Artificial Sequence
  Synthetically generated peptide
  VARIANT 8: Xaa = a hydrophilic amino acid, e.g., glutamine or asparagine
  VARIANT 10: Xaa = a small amino acid, e.g., Gly,Ala, Val, or Ser
VISPSGGXTXYADSAVKG

SEQ ID NO: 151 - protein, 5 aa, Artificial Sequence
  Synthetically generated peptide
  VARIANT 3: Xaa = any amino acid or optionally aliphatic, e.g., Ile or Val
QSXSS

SEQ ID NO: 152 - protein, 11 aa, Artificial Sequence
  Synthetically generated peptide
  VARIANT 6: Xaa = any amino acid or optionally aliphatic, e.g., Ile or Val
RASQSXSSYLA

SEQ ID NO: 153 - protein, 6 aa, Artificial Sequence
  Synthetically generated peptide
  VARIANT 3: Xaa = any amino acid or optionally a hydrophilic amino acid, e.g., serine or asparagine
  VARIANT 5: Xaa = any amino acid or optionally aliphatic or small aliphatic, e.g., alanine or valine
ASXRXT

SEQ ID NO: 154 - protein, 7 aa, Artificial Sequence
  Synthetically generated peptide
  VARIANT 4: Xaa = any amino acid or optionally a hydrophilic amino acid, e.g., serine or asparagine
  VARIANT 6: Xaa = any amino acid or optionally aliphatic or small aliphatic, e.g., alanine or valine
DASXRXT

SEQ ID NO: 155 - protein, 7 aa, Artificial Sequence
  Synthetically generated peptide
  VARIANT 4: Xaa = any amino acid or optionally Lys or Ser
QRSXWPR

SEQ ID NO: 156 - protein, 9 aa, Artificial Sequence
  Synthetically generated peptide
  VARIANT 1: Xaa = any amino acid or optionally Leu or Gln
  VARIANT 5: Xaa = any amino acid or optionally Lys or Ser
XQRSXWPRT

SEQ ID NO: 157 - protein, 107 aa, Artificial Sequence
  Synthetically generated oligonucleotide
DIQMTQSPATLSLSPGERATLSCRASQSVSSYLAWYQQKPGQAPRLLIYDASNRATGIPARFSGSGSETDFTLTISSLEPEDFAVYYCQQRSKWPRTFGQGTKLEIK

SEQ ID NO: 158 - protein, 107 aa, Artificial Sequence
  Synthetically generated oligonucleotide
DIQMTQSPATLSLSPGERATLSCRASQSISSYLAWYQQKPGQPPRLLIYDASSRVTGIPARFSGSGFGTDFTLTISSLEPEDFAVYYCLQRSSWPRTFGQGTKLEIK

SEQ ID NO: 159 - protein, 107 aa, Artificial Sequence
  The germlined E3 sequence
DIQMTQSPSSLSASVGDRVTITCRASQGIGHYLAWYQQKPGKVPKLLIYTASTLQSGVPSRFSGSGSGTDFTLTISSLQPEDVATYYCQQFNSYPHTFGQGTRLEIK

SEQ ID NO: 160 - protein, 10 aa, Artificial Sequence
  Synthetically generated peptide
  VARIANT 1: Xaa = Gly, Ser, Val
  VARIANT 3: Xaa = Ser, Tyr
  VARIANT 8: Xaa = Trp, Asn, Gln
  VARIANT 10: Xaa = Gly, Tyr
XIXPSGGXTX

SEQ ID NO: 161 - protein, 9 aa, Artificial Sequence
  Synthetically generated peptide
  VARIANT 3: Xaa = Ser, Tyr, Phe, Arg
  VARIANT 4: Xaa = Gly, Ser, Tyr, Asn
  VARIANT 6: Xaa = Ser, Thr,Tyr, Trp
  VARIANT 7: Xaa = Arg. Pro
  VARIANT 8: Xaa = Leu, Trp, Arg, His
  VARIANT 9: Xaa = Thr, Ile, Tyr
QQXXSXXXX

SEQ ID NO: 162 - protein, 1124 aa, Homo sapiens
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIPRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATIIQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 163 - protein, 497 aa, Homo sapiens
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 164 - protein, 110 aa, ARTIFICIAL SEQUENCE
  Antibody
QSELTQPPSASGTPGQRVTISCSGSSSSIGLNPVNWYQQLPGTAPKVVIHSNDQRPSGVPDRFSGSKSGTSASLAISGLQSEDEADYYCAAWDDSLNGPAFGGGTKLTVL

SEQ ID NO: 165 - DNA, 331 bp, ARTIFICIAL SEQUENCE
  Antibody
cagagcgaattgactcagccaccctcagcgtctgggacccccgggcagagggtcaccatctcttgttctggaagcagctccagcatcggacttaatcctgtaaactggtaccagcagctcccaggaacggcccccaaagtagtcatccatagtaatgatcagcggccctcaggggtccctgaccgattctctggctccaagtctggcacctcagcctccctggccatcagtggactccagtctgaggatgaggctgattattactgtgcagcatgggatgacagcctgaatggtccggcattcggcggagggaccaagctgaccgtcctag

SEQ ID NO: 166 - protein, 117 aa, ARTIFICIAL SEQUENCE
  Antibody
EVQLLESGGGLVQPGGSLRLSCAASGFTFSSYVMMWVRQAPGKGLEWVSRIYPSGGITQYADSVKGRFTISRDNSKNTLYLQMNSLRAEDTAVYYCARDVYRAFDIWGQGTMVTVSS

SEQ ID NO: 167 - DNA, 351 bp, ARTIFICIAL SEQUENCE
  Antibody
gaagttcaattgttagagtctggtggcggtcttgttcagcctggtggttctttacgtctttcttgcgctgcttccggattcactttctcttcttacgttatgatgtgggttcgccaagctcctggtaaaggtttggagtgggtttctcgtatctatccttctggtggcattactcagtatgctgactccgttaaaggtcgcttcactatctctagagacaactctaagaatactctctacttgcagatgaacagcttaagggctgaggacacggccgtgtattactgtgcaagagatgtctacagggcttttgatatctggggccaagggacaatggtcaccgtctcaagc

SEQ ID NO: 168 - protein, 111 aa, ARTIFICIAL SEQUENCE
  Antibody
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPPGGTFGQGTKVEIK

SEQ ID NO: 169 - DNA, 333 bp, ARTIFICIAL SEQUENCE
  Antibody
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccggggggaacgttcggccaagggaccaaggtggaaatcaaa

SEQ ID NO: 170 - protein, 125 aa, ARTIFICIAL SEQUENCE
  Antibody
EVQLLESGGGLVQPGGSLRLSCAASGFTFSSYKMHWVRQAPGKGLEWVSSIYPSGGYTYYADSVKGRFTISRDNSKNTLYLQMNSLRAEDTAVYYCARDSHHFHFWGDYYFLEYWGQGTLVTVSS

SEQ ID NO: 171 - DNA, 375 bp, ARTIFICIAL SEQUENCE
  Antibody
gaagttcaattgttagagtctggtggcggtcttgttcagcctggtggttctttacgtctttcttgcgctgcttccggattcactttctcttcttacaagatgcattgggttcgccaagctcctggtaaaggtttggagtgggtttcttctatctatccttctggtggctatacttattatgctgactccgttaaaggtcgcttcactatctctagagacaactctaagaatactctctacttgcagatgaacagcttaagggctgaggacacggccgtatattactgtgcgagagatagccatcatttccatttttggggtgactattattttctagaatactggggccagggaaccctggtcaccgtctcaagc

SEQ ID NO: 172 - protein, 108 aa, ARTIFICIAL SEQUENCE
  Antibody
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGGGTKVEIK

SEQ ID NO: 173 - DNA, 324 bp, ARTIFICIAL SEQUENCE
  Antibody
caagacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcccactttcggcggagggaccaaggtggagatcaaa

SEQ ID NO: 174 - protein, 125 aa, ARTIFICIAL SEQUENCE
  Antibody
EVQLLESGGGLVQPGGSLRLSCAASGFTFSQYLMFWVRQAPGKGLEWVSYIYPSGGWTMYADSVKGRFTISRDNSKNTLYLQMNSLRAEDTAVYYCARQNYYDSSGYYYRGFDYWGQGTLVTVSS

SEQ ID NO: 175 - DNA, 375 bp, ARTIFICIAL SEQUENCE
  Antibody
gaagttcaattgttagagtctggtggcggtcttgttcagcctggtggttctttacgtctttcttgcgctgcttccggattcactttctctcagtaccttatgttttgggttcgccaagctcctggtaaaggtttggagtgggtttcttatatctatccttctggtggctggactatgtatgctgactccgttaaaggtcgcttcactatctctagagacaactctaagaatactctctacttgcagatgaacagcttaagggctgaggacacggccgtgtattactgtgcgaggcaaaattactatgatagtagtggttattactatcgtggctttgactactggggccagggaaccctggtcaccgtctcaagc

SEQ ID NO: 176 - protein, 109 aa, ARTIFICIAL SEQUENCE
  Antibody
DIHMTQSPATLSLSPGERATLSCRASQSVSSYLAWYQQKPGQAPRLLIYDASNRATGIPARFSGSGSGTDFTLTISSLEPEDFAVYYCQQRSNWPPGITFGGGTKVEIK

SEQ ID NO: 177 - DNA, 327 bp, ARTIFICIAL SEQUENCE
  Antibody
gacatccatatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccggggatcactttcggcggagggaccaaggtggagatcaaa

SEQ ID NO: 178 - protein, 117 aa, ARTIFICIAL SEQUENCE
  Antibody
EVQLLESGGGLVQPGGSLRLSCAASGFTFSSYKMGWVRQAPGKGLEWVSSIYPSGGWTHYADSVKGRFTISRDNSKNTLYLQMNSLRAEDTAVYYCARVLLHYFDYWGQGTLVTVSS

SEQ ID NO: 179 - DNA, 351 bp, ARTIFICIAL SEQUENCE
  Antibody
gaagttcaattgttagagtctggtggcggtcttgttcagcctggtggttctttacgtctttcttgcgctgcttccggattcactttctcttcttacaagatgggttgggttcgccaagctcctggtaaaggtttggagtgggtttcttctatctatccttctggtggctggactcattatgctgactccgttaaaggtcgcttcactatctctagagacaactctaagaatactctctacttgcagatgaacagcttaagggctgaggacactgcagtctactattgtgcaagagtactactacactactttgactactggggccagggaaccctggtcaccgtctcaagc

SEQ ID NO: 180 - protein, 108 aa, ARTIFICIAL SEQUENCE
  Antibody
QDIQMTQSPSFLSASVGDRVTISCRASQYISIYLNWYQQRPGEAPKLLINAASSLQSGDPSRFSGSGSGTDFTLTINSLQPDDFATYYCQQYKSYPLTFGEGTKVEIK

SEQ ID NO: 181 - DNA, 324 bp, ARTIFICIAL SEQUENCE
  Antibody
caagacatccagatgacccagtctccatccttcctgtccgcatctgtaggagacagagtcaccatctcttgccgggcaagtcagtacatcagcatatatttgaattggtatcagcagagaccaggggaagcccctaaactcctgatcaatgctgcatccagtttgcaaagtggggacccatcaaggttcagtggcagtggatctgggacagatttcactctcaccatcaacagcctgcagcctgatgattttgcaacttattactgccaacagtataagagttaccccctcactttcggcgaggggaccaaggtggagatcaaa

SEQ ID NO: 182 - protein, 118 aa, ARTIFICIAL SEQUENCE
  Antibody
EVQLLESGGGLVQPGGSLRLSCAASGFTFSAYGMGWVRQAPGKGLEWVSVISPSGGQTSYADSVKGRFTISRDNSKNTLYLQMNSLRAEDTALYYCAGGDRYGPLHYWGQGTLVTVSS

SEQ ID NO: 183 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctgcttacggtatgggttgggttcgccaagctcctggtaaaggtttggagtgggtttctgttatctctccttctggtggccagacttcttatgctgactccgttaaaggtcgcttcactatctctagagacaactctaagaatactctctacttgcagatgaacagcttaagggctgaggacaccgccttgtattactgtgcgggaggggacaggtatggacccttgcactactggggccagggaaccctggtcaccgtctcaagc

SEQ ID NO: 184 - protein, 108 aa, ARTIFICIAL SEQUENCE
  Antibody
QDIQMTQSPSSLSASVGDRVTITCQASQDISNYLNWYQQKPGKAPKLLIYHASNLETGVPSRFSGSGSGTDFTLTISSLQPEDFATYYCLQYKSYPRLFGQGTKVEVK

SEQ ID NO: 185 - DNA, 324 bp, ARTIFICIAL SEQUENCE
  Antibody
caagacatccagatgacccagtctccatcctccctgtctgcatctgtaggagacagagtcaccatcacttgccaggcgagtcaggacattagcaactatttaaattggtatcagcagaaaccagggaaagcccctaagctcctgatctaccatgcatccaatttggaaacaggggtcccatcaaggttcagtggaagtggatctgggacagatttcactctcaccatcagcagtctgcaacctgaagattttgcaacttattactgtcttcagtataaaagttaccctcgattgttcggccaagggaccaaggtggaagtcaaa

SEQ ID NO: 186 - protein, 122 aa, ARTIFICIAL SEQUENCE
  Antibody
EVQLLESGGGLVQPGGSLRLSCAASGFTFSNYKMNWVRQAPGKGLEWVSVIYPSGGWTYYADSVKGRFTISRDNSKNTLYLQMNSLRAEDTAVYYCASGYYDSSGYSRFDYWGQGTLVTVSS

SEQ ID NO: 187 - DNA, 366 bp, ARTIFICIAL SEQUENCE
  Antibody
gaagttcaattgttagagtctggtggcggtcttgttcagcctggtggttctttacgtctttcttgcgctgcttccggattcactttctctaattacaagatgaattgggttcgccaagctcctggtaaaggtttggagtgggtttctgttatctatccttctggtggctggacttattatgctgactccgttaaaggtcgcttcactatctctagagacaactctaagaatactctctacttgcagatgaacagcttaagggctgaggacacggctgtgtattactgtgcgagtggttactatgatagtagtggttactcccgatttgactactggggccagggaaccctggtcaccgtctcaagc

SEQ ID NO: 188 - protein, 110 aa, ARTIFICIAL SEQUENCE
  Antibody
QSALTQPASVSGSPGQSITISCTGTSSDVGSYNLVSWYQQHPGKAPQLMIYEGSKRPSGLSNRFSGSKSDNTASLTISGLQAEDEADYYCCSYAGSSTLVFGGGTKLTVL

SEQ ID NO: 189 - DNA, 330 bp, ARTIFICIAL SEQUENCE
  Antibody
cagagcgctttgactcagcctgcctccgtgtctgggtctcctggacagtcgatcaccatctcctgcactggaaccagcagtgatgttgggagttataaccttgtctcctggtaccaacaacacccaggcaaagccccccaactcatgatttatgagggcagtaagcggccctcaggactttctaatcgcttctctggctccaagtctgacaacacggcctccctgacaatctctgggctccaggctgaggacgaggctgattattactgctgctcatatgcaggtagtagcactttagtattcggcggagggaccaagctgaccgtccta

SEQ ID NO: 190 - protein, 117 aa, ARTIFICIAL SEQUENCE
  Antibody
EVQLLESGGGLVQPGGSLRLSCAASGFTFSRYKMGWVRQAPGKGLEWVSSIYPSGGPTYYADSVKGRFTISRDNSKNTLYLQMNSLRAEDTAMYYCARSEVGAPDYWGQGTLVTVSS

SEQ ID NO: 191 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctcgttacaagatgggttgggttcgccaagctcctggtaaaggtttggagtgggtttcttctatctatccttctggtggccctacttattatgctgactccgttaaaggtcgcttcactatctctagagacaactctaagaatactctctacttgcagatgaacagcttaagggctgaggacacagccatgtattactgtgcgagaagcgaagtgggagcccccgactactggggccagggaaccctggtcaccgtctcaagc

SEQ ID NO: 192 - protein, 108 aa, ARTIFICIAL SEQUENCE
  Antibody
QDIQMTQSPSTLSASVGDTVTMTCRASQSISGWLAWYQQKPGKAPNLLIFKASTLKSGVPSRFRGSGSGTEFTLTISSLQPDDFATYYCQQYNSYSQTFGQGTKVEIK

SEQ ID NO: 193 - DNA, 324 bp, ARTIFICIAL SEQUENCE
  Antibody
caagacatccagatgacccagtctccttccaccctttctgcatctgtaggagacaccgtcaccatgacttgccgggccagtcagagtattagtgggtggttggcctggtatcagcagaaaccagggaaagcccctaacctcctgatctttaaggcgtctactttaaaaagtggggtcccgtcaaggtttcgcggcagtggatctgggacagaattcactctcaccatcagcagcctgcagcctgatgattttgcaacttattactgccaacaatataatagttattctcagacgttcggccaagggaccaaggtggaaatcaaa

SEQ ID NO: 194 - protein, 121 aa, ARTIFICIAL SEQUENCE
  Antibody
EVQLLESGGGLVQPGGSLRLSCAASGFTFSMYKMHWVRQAPGKGLEWVSSIYPSGGYTVYADSVKGRFTISRDNSKNTLYLQMNSLRAEDTAVYYCATDRWSSGGYGVDFWGQGTLVTVSS

SEQ ID NO: 195 - DNA, 363 bp, ARTIFICIAL SEQUENCE
  Antibody
gaagttcaattgttagagtctggtggcggtcttgttcagcctggtggttctttacgtctttcttgcgctgcttccggattcactttctctatgtacaagatgcattgggttcgccaagctcctggtaaaggtttggagtgggtttcttctatctatccttctggtggctatactgtttatgctgactccgttaaaggtcgcttcactatctctagagacaactctaagaatactctctacttgcagatgaacagcttaagggctgaggacacggccgtgtattactgtgccacagaccggtggagcagtggcgggtacggtgttgacttctggggccagggaaccctggtcaccgtctcaagc

SEQ ID NO: 196 - protein, 112 aa, ARTIFICIAL SEQUENCE
  Antibody
QDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPQFGQGTKVEIK

SEQ ID NO: 197 - DNA, 336 bp, ARTIFICIAL SEQUENCE
  Antibody
caagacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcagttcggccaagggaccaaggtggaaatcaag

SEQ ID NO: 198 - protein, 118 aa, ARTIFICIAL SEQUENCE
  Antibody
EVQLLESGGGLVQPGGSLRLSCAASGFTFSHYDMSWVRQAPGKGLEWVSYIYPSGGPTYYADSVKGRFTISRDNSKNTLYLQMNSLRAEDTAVYYCARGDWASRFATWGQGTTVTVSS

SEQ ID NO: 199 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctcattacgatatgtcttgggttcgccaagctcctggtaaaggtttggagtgggtttcttatatctatccttctggtggccctacttattatgctgactccgttaaaggtcgcttcactatctctagagacaactctaagaatactctctacttgcagatgaacagcttaagggctgaggacacggccgtgtattactgtgcaagaggcgattgggcttctcgttttgccacctggggccaggggaccacggtcaccgtctcaagc

SEQ ID NO: 200 - protein, 108 aa, ARTIFICIAL SEQUENCE
  Antibody
QYELTQPPSVSVAPGQTARITCGGNNIGIKSVNWYQQKPGQAPVLVVYDDSGRPSGIPQRFSGSNSGNTATLTINRVEAGDEADYYCQVWDSGSDHWVFGGGTKLTVL

SEQ ID NO: 201 - DNA, 324 bp, ARTIFICIAL SEQUENCE
  Antibody
cagtacgaattgactcagccaccctcggtgtcagtggccccaggacagacggccaggattacctgtgggggaaacaacattggaattaaaagtgtgaactggtaccagcagaagccaggccaggcccctgtgctggtcgtctatgatgatagtggccggccctcagggatccctcagcgattctctggctccaactctgggaacacggccaccctgaccatcaacagggtcgaagccggggatgaggccgactattactgtcaggtgtgggatagtggtagtgatcattgggtgttcggcggagggaccaagctgaccgtccta

SEQ ID NO: 202 - protein, 121 aa, ARTIFICIAL SEQUENCE
  Antibody
EVQLLESGGGLVQPGGSLRLSCAASGFTFSHYKMGWVRQAPGKGLEWVSSIYPSGGFTRYADSVKGRFTISRDNSKNTLYLQMNSLRAEDTAVYYCARNFVESSHYYHDYWGQGTLVTVSS

SEQ ID NO: 203 - DNA, 363 bp, ARTIFICIAL SEQUENCE
  Antibody
gaagttcaattgttagagtctggtggcggtcttgttcagcctggtggttctttacgtctttcttgcgctgcttccggattcactttctctcattacaagatgggttgggttcgccaagctcctggtaaaggtttggagtgggtttcttctatctatccttctggtggctttactcgttatgctgactccgttaaaggtcgcttcactatctctagagacaactctaagaatactctctacttgcagatgaacagcttaagggctgaggacacggccgtgtattactgtgccagaaatttcgttgaaagtagtcattattaccatgactattggggccagggaaccctggtcaccgtctcaagc

SEQ ID NO: 204 - protein, 108 aa, ARTIFICIAL SEQUENCE
  Antibody
QSELTQPPSVSVAPGQTAVITCGGSNIGGKSVHWYQQKSGQAPVLVVFDDRDRPSGIPERFSGSNSGNTATLTITRVEVGDEADYYCQVWDSGTDHRVFGGGTRLTAL

SEQ ID NO: 205 - DNA, 324 bp, ARTIFICIAL SEQUENCE
  Antibody
cagagcgaattgactcagccaccctcggtgtcagtggccccagggcagacggccgtgattacctgtggggggagcaacattggaggtaaaagtgtacactggtaccagcagaagtcaggccaggcccctgtgctggtcgtctttgatgatcgcgaccggccctcagggatccctgagcgattctctggctccaactccgggaacacggccaccctgaccatcaccagggtcgaagtcggggatgaggccgactattactgtcaggtgtgggatagtggaactgatcatcgggtgttcggcggagggaccaggctgaccgcccta

SEQ ID NO: 206 - protein, 118 aa, ARTIFICIAL SEQUENCE
  Antibody
EVQLLESGGGLVQPGGSLRLSCAASGFTFSRYVMFWVRQAPGKGLEWVSGIYPSGGHTRYADSVKGRFTISRDNSKNTLYLQMNSLRAEDTAVYYCARRGSGGYFDYWGQGTLVTVSS

SEQ ID NO: 207 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctcgttacgttatgttttgggttcgccaagctcctggtaaaggtttggagtgggtttctggtatctatccttctggtggccatactcgttatgctgactccgttaaaggtcgcttcactatctctagagacaactctaagaatactctctacttgcagatgaacagcttaagggctgaggacacggccgtgtattactgtgcgagacgaggctcggggggctactttgactactggggccagggcaccctggtcaccgtctcaagc

SEQ ID NO: 208 - protein, 107 aa, ARTIFICIAL SEQUENCE
  Antibody
QSALTQDPAVSVALGQTVRITCRGDRLRSYYSSWYQQKPRQAPVLVMFGRNNRPSGIPDRFSGSTSGSTASLTITATQADDEADYFCSSRDGSGNFLFGGGTKLTVL

SEQ ID NO: 209 - DNA, 321 bp, ARTIFICIAL SEQUENCE
  Antibody
cagagcgctttgactcaggaccctgctgtgtctgtggccttggggcagacagtcaggatcacatgccgaggagacagactcagaagttattattcaagttggtaccagcagaagccacgacaggcccctgttcttgtcatgtttggtagaaacaaccggccctcagggatcccagaccgattctctggctccacctcaggaagcacagcttccttgaccatcactgcgactcaggcggacgatgaggctgactatttctgtagttcccgggacggcagtggtaatttcctcttcggcggagggaccaaactgaccgtcctt

SEQ ID NO: 210 - protein, 124 aa, ARTIFICIAL SEQUENCE
  Antibody
EVQLLESGGGLVQPGGSLRLSCAASGFTFSRYKMIWVRQAPGKGLEWVSSIYPSGGTTSYADSVKGRFTISRDNSKNTLYLQMNSLRAEDTAVYYCARSDLGSGWYSAEYFQHWGQGTLVTVSS

SEQ ID NO: 211 - DNA, 372 bp, ARTIFICIAL SEQUENCE
  Antibody
gaagttcaattgttagagtctggtggcggtcttgttcagcctggtggttctttacgtctttcttgcgctgcttccggattcactttctctcgttacaagatgatttgggttcgccaagctcctggtaaaggtttggagtgggtttcttctatctatccttctggtggcactacttcttatgctgactccgttaaaggtcgcttcactatctctagagacaactctaagaatactctctacttgcagatgaacagcttaagggctgaggacacggctgtgtattactgtgcgagaagcgacctaggcagtggctggtatagcgctgaatacttccagcactggggccagggcaccctggtcaccgtctcaagc

SEQ ID NO: 212 - protein, 110 aa, ARTIFICIAL SEQUENCE
  Antibody
QDIQMTQSPGTLSLSPGERATLSCRASQSVSGNLLAWYQQKPGQAPRLLIYGASSRATGIPDRFSGSGSGTDFTLTITRLEPEDFAVYFCQQYGGSPPVTFGGGTKVEIK

SEQ ID NO: 213 - DNA, 330 bp, ARTIFICIAL SEQUENCE
  Antibody
caagacatccagatgacccagtctccaggcaccctgtctttgtctccaggggaaagagccaccctctcctgcagggccagtcagagtgttagcggcaacctcttagcctggtatcagcagaaacctggccaggctcccagactcctcatctatggtgcatccagcagggccactggcatcccagacaggttcagtggcagtgggtctgggacagacttcactctcaccatcaccagactggagcctgaagattttgcagtgtatttctgtcagcagtatggtggctcacctccggtcactttcggcggagggaccaaggtggagatcaaa

SEQ ID NO: 214 - protein, 125 aa, ARTIFICIAL SEQUENCE
  Antibody
EVQLLESGGGLVQPGGSLRLSCAASGFTFSSYLMIWVRQAPGKGLEWVSRIYPSGGGTEYADSVKGRFTISRDNSKNTLYLQMNSLRAEDTAVYYCARVTYYYDSSGYQPAFDIWGQGTMVTVSS

SEQ ID NO: 215 - DNA, 375 bp, ARTIFICIAL SEQUENCE
  Antibody
gaagttcaattgttagagtctggtggcggtcttgttcagcctggtggttctttacgtctttcttgcgctgcttccggattcactttctcttcttaccttatgatttgggttcgccaagctcctggtaaaggtttggagtgggtttctcgtatctatccttctggtggcggtactgagtatgctgactccgttaaaggtcgcttcactatctctagagacaactctaagaatactctctacttgcagatgaacagcttaagggctgaggacacggccgtgtattactgtgcgagagtcacgtattactatgatagtagtggttatcaacccgcttttgatatctggggccaagggacaatggtcaccgtctcaagc

SEQ ID NO: 216 - protein, 108 aa, ARTIFICIAL SEQUENCE
  Antibody
QDIQMTQSPATLSLSPGERATLSCRASQSVSSYLAWYQQKPGQAPRLLIYDASNRATGIPARFSGSGSGTDFTLIISSLEPEDFAVYYCQQRSNWPRTFGQGTKVEIK

SEQ ID NO: 217 - DNA, 324 bp, ARTIFICIAL SEQUENCE
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcatcatcagcagcctagagcctgaagattttgcagtttattattgtcagcagcgtagcaactggcctcgaacgttcggccaagggaccaaggtggaaatcaaa

SEQ ID NO: 218 - protein, 116 aa, ARTIFICIAL SEQUENCE
  Antibody
EVQLLESGGGLVQPGGSLRLSCAASGFTFSHYGMTWVRQAPGKGLEWVSVIGPSGGNTMYADSVKGRFTISRDNSKNTLYLQMNSLRAEDTAVYYCARVWGAFDIWGQGTMVTVSS

SEQ ID NO: 219 - DNA, 348 bp, ARTIFICIAL SEQUENCE
  Antibody
gaagttcaattgttagagtctggtggcggtcttgttcagcctggtggttctttacgtctttcttgcgctgcttccggattcactttctctcattacggtatgacttgggttcgccaagctcctggtaaaggtttggagtgggtttctgttatcggtccttctggtggcaatactatgtatgctgactccgttaaaggtcgcttcactatctctagagacaactctaagaatactctctacttgcagatgaacagcttaagggctgaggacacggccgtgtattactgtgcgagagtatggggtgcttttgatatctggggccaagggacaatggtcaccgtctcaagc

SEQ ID NO: 220 - protein, 109 aa, ARTIFICIAL SEQUENCE
  Antibody
QDIQMTQSPATLSVSPGERATLSCRASQSVYNNLAWYQQKPGQAPRLLIYDASTTATGIPARFSGSGSGTDFTLTITSLEPEDFAVYYCQQRSNWPSLTFGGGTKVEIK

SEQ ID NO: 221 - DNA, 327 bp, ARTIFICIAL SEQUENCE
  Antibody
caagacatccagatgacccagtctccagccaccctgtctgtgtctccaggggaacgagccaccctctcctgcagggccagtcagagtgtttacaacaacttagcctggtaccaacagaaacctggccaggctcccaggctcctcatctatgatgcatccaccacggccactggcatcccagccaggttcagtggcagtgggtctgggacagacttcactctcaccatcaccagcctagagcctgaagattttgcagtttattactgtcagcagcgtagcaactggccctcgctcactttcggcggagggaccaaggtggagatcaaa

SEQ ID NO: 222 - protein, 117 aa, ARTIFICIAL SEQUENCE; identical to SEQ ID NO: 178
  Antibody

SEQ ID NO: 223 - DNA, 351 bp, ARTIFICIAL SEQUENCE; identical to SEQ ID NO: 179
  Antibody

SEQ ID NO: 224 - protein, 105 aa, ARTIFICIAL SEQUENCE
  Antibody
QDIQMTQSPSFLSASLGDRVTITCRATQGIGTFLAWYQQKAGRAPKLLIYGASTLQSGVPSRFSGSGSGTEFTLTISSLQPEDFATYYCQQPNSFFGQGTKLEIK

SEQ ID NO: 225 - DNA, 315 bp, ARTIFICIAL SEQUENCE
  Antibody
caagacatccagatgacccagtctccatccttcctgtctgcatctttaggagacagagtcaccatcacttgtcgggccactcagggcatcggcacttttttagcctggtatcagcaaaaagcagggagagcccctaaactcctgatctatggtgcttccactttgcagagtggggtcccatcaaggttcagcggcagtggatctgggacagaattcactctcacaataagcagcctgcagcctgaagattttgcaacttattactgtcaacagcctaatagtttttttgggcaggggaccaagctggagatcaaa

SEQ ID NO: 226 - protein, 117 aa, ARTIFICIAL SEQUENCE; identical to SEQ ID NO: 178
  Antibody

SEQ ID NO: 227 - DNA, 351 bp, ARTIFICIAL SEQUENCE; identical to SEQ ID NO: 179
  Antibody

SEQ ID NO: 228 - protein, 108 aa, ARTIFICIAL SEQUENCE
  Antibody
QDIQMTQSPSSVSASVGDRVTITCRASQDISSWLVWYQQKPGKAPKLLIHDASNLQSGVPSRFSGSGSGTDFTLTINSLQPEDFATYYCQQANSFPVTFGGGTKVEIK

SEQ ID NO: 229 - DNA, 324 bp, ARTIFICIAL SEQUENCE
  Antibody
caagacatccagatgacccagtctccatcttccgtgtctgcatctgtaggagacagagtcaccattacttgtcgggcgagtcaggatattagcagttggttagtctggtatcagcagaaaccagggaaagcccctaagctcctgatccatgatgcatccaatttgcaaagtggggtcccatcaaggttcagcggcagtgggtctgggacagattttactctcaccatcaacagcctgcagcctgaagattttgcaacttactattgtcaacaggctaacagtttcccggtcactttcggcggagggaccaaggtggagatcaaa

SEQ ID NO: 230 - protein, 120 aa, ARTIFICIAL SEQUENCE
  Antibody
EVQLLESGGGLVQPGGSLRLSCAASGFTFSAYPMLWVRQAPGKGLEWVSSISPSGGATAYADSVKGRFTISRDNSKNTLYLQMNSLRAEDTAVYYCAKGSYSDYGVFESWGQGTLVTVSS

SEQ ID NO: 231 - DNA, 360 bp, ARTIFICIAL SEQUENCE
  Antibody
gaagttcaattgttagagtctggtggcggtcttgttcagcctggtggttctttacgtctttcttgcgctgcttccggattcactttctctgcttaccctatgctttgggttcgccaagctcctggtaaaggtttggagtgggtttcttctatctctccttctggtggcgctactgcttatgctgactccgttaaaggtcgcttcactatctctagagacaactctaagaatactctctacttgcagatgaacagcttaagggctgaggacacggccgtgtattactgtgcgaaaggctcatacagtgattacggggtctttgagtcctggggccagggaaccctggtcaccgtctcaagc

SEQ ID NO: 232 - protein, 110 aa, ARTIFICIAL SEQUENCE
  Antibody
QRVLTQPPSASGTPGQRVTISCSGSSSNVGSNNVNWYQQLPGQAPKLLIDSNNHRPSGVPDRFSGSKSGTSASLALSGLQSEDEADYYCATWDDNLIAPVFGGGTKLTVL

SEQ ID NO: 233 - DNA, 330 bp, ARTIFICIAL SEQUENCE
  Antibody
cagagggtcttgactcagccaccctcagcgtctgggacccccgggcagagggtcaccatctcctgttctggaagcagctccaatgtcggaagtaataatgtaaactggtatcagcagctcccaggacaggcccccaaactcctcatcgatagtaataatcaccggccctcaggggtccctgaccgattctctggctccaagtctggcacctcagcctccctggccctcagtgggctccagtctgaggatgaggctgattattattgtgcgacatgggacgacaacctgattgccccggtattcggcggagggaccaagctgaccgtccta

SEQ ID NO: 234 - protein, 128 aa, ARTIFICIAL SEQUENCE
  Antibody
EVQLLESGGGLVQPGGSLRLSCAASGFTFSRYRMSWVRQAPGKGLEWVSGIVPSGGWTTYADSVKGRFTISRDNSKNTLYLQMNSLRAEDTAVYYCARDNYYDFWSGYYISRFGMDVWGQGTTVTVSS

SEQ ID NO: 235 - DNA, 384 bp, ARTIFICIAL SEQUENCE
  Antibody
gaagttcaattgttagagtctggtggcggtcttgttcagcctggtggttctttacgtctttcttgcgctgcttccggattcactttctctcgttaccgtatgtcttgggttcgccaagctcctggtaaaggtttggagtgggtttctggtatcgttccttctggtggctggactacttatgctgactccgttaaaggtcgcttcactatctctagagacaactctaagaatactctctacttgcagatgaacagcttaagggctgaggacactgcagtctactattgtgcgagagataactattacgatttttggagtggttattatatttctcgattcggtatggacgtctggggccaagggaccacggtcaccgtctcaagc

SEQ ID NO: 236 - protein, 110 aa, ARTIFICIAL SEQUENCE
  Antibody
QYELTQPASVSGSPGQSITISCTGSSSDVSGYNYVSWYQHHPGKAPKLMLYDVSNRPSGVSNRFSGSKSGNTASLTISGLQAEDEADYYCSSYTSSSTWVFGGGTKLTVL

SEQ ID NO: 237 - DNA, 330 bp, ARTIFICIAL SEQUENCE
  Antibody
cagtacgaattgactcagcctgcctccgtgtctgggtctcctggacagtcgatcaccatctcctgcactggatccagcagtgacgttagtggttataactatgtctcctggtaccaacaccacccaggcaaagcccccaaactcatgctttatgatgtcagtaatcggccctcaggggtttctaatcgcttctctggctccaagtctggcaacacggcctccctgaccatctctgggctccaggctgaggacgaggctgattattactgcagctcatatacaagcagcagcacttgggtgttcggcggagggaccaagctgaccgtccta

SEQ ID NO: 238 - protein, 123 aa, ARTIFICIAL SEQUENCE
  Antibody
EVQLLESGGGLVQPGGSLRLSCAASGFTFSSYMMFWVRQAPGKGLEWVSRIYPSGGWTYYADSVKGRFTISRDNSKNTLYLQMNSLRAEDTAVYYCARVTVPLDSGSYYFDYWGQGTLVTVSS

SEQ ID NO: 239 - DNA, 369 bp, ARTIFICIAL SEQUENCE
  Antibody
gaagttcaattgttagagtctggtggcggtcttgttcagcctggtggttctttacgtctttcttgcgctgcttccggattcactttctcttcttacatgatgttttgggttcgccaagctcctggtaaaggtttggagtgggtttctcgtatctatccttctggtggctggacttattatgctgactccgttaaaggtcgcttcactatctctagagacaactctaagaatactctctacttgcagatgaacagcttaagggctgaggacacggccgtgtattactgtgcgagagttacggtaccccttgatagtgggagctactactttgactactggggccagggaaccctggtcaccgtctcaagc

SEQ ID NO: 240 - protein, 108 aa, ARTIFICIAL SEQUENCE
  Antibody
QDIQMTQSPSSLSASVGDRVTITCRASQGIRNDLGWYQQKPGKAPKLLIYAASSLQSGVPSRFSGSGSGTDFTLTISSLQPEDFATYYCLQDYNYPWTFGQGTNVEIK

SEQ ID NO: 241 - DNA, 324 bp, ARTIFICIAL SEQUENCE
  Antibody
caagacatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattacccgtggacgttcggccaagggaccaatgtggaaatcaaa

SEQ ID NO: 242 - protein, 125 aa, ARTIFICIAL SEQUENCE
  Antibody
EVQLLESGGGLVQPGGSLRLSCAASGFTFSSYLMTWVRQAPGKGLEWVSSIYPSGGWTYYADSVKGRFTISRDNSKNTLYLQMNSLRAEDTATYYCAREMYYDFWSGYYRGFDIWGQGTTVTVSS

SEQ ID NO: 243 - DNA, 375 bp, ARTIFICIAL SEQUENCE
  Antibody
gaagttcaattgttagagtctggtggcggtcttgttcagcctggtggttctttacgtctttcttgcgctgcttccggattcactttctcttcttaccttatgacttgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacacagccacatattactgtgcgagagagatgtattacgatttttggagtggttattatcgaggttttgatatctggggccaagggaccacggtcaccgtctcaagc

SEQ ID NO: 244 - protein, 108 aa, ARTIFICIAL SEQUENCE
  Antibody
QDIQMTQSPSTLSASIGDRVTITCRASQRVSTWVAWYQQKPGRAPKLLIYMASRLESGVPSRFSGSGSGTEFTLTISSLQPDDFATYWCQQYNFYPRTFGQGTKVDIK

SEQ ID NO: 245 - DNA, 324 bp, ARTIFICIAL SEQUENCE
  Antibody
caagacatccagatgacccagtctccttccaccctgtctgcatctataggagacagagtcaccatcacttgccgggccagtcagcgtgttagtacttgggtggcctggtatcagcagaaaccagggagagccccaaaactcttgatctatatggcgtctaggttagaaagtggggtcccatcaaggttcagcggcagtggatctgggacagagttcactctcaccataagcagcctgcagcctgatgattttgctacttattggtgccaacaatataatttttatcctcggacgttcggccaagggaccaaggtggacatcaaa

SEQ ID NO: 246 - protein, 119 aa, ARTIFICIAL SEQUENCE
  Antibody
EVQLLESGGGLVQPGGSLRLSCAASGFTFSWYGMNWVRQAPGKGLEWVSSISPSGGQTPYADSVKGRFTISRDNSKNTLYLQMNSLRAEDTAVYYCARDLGGAYIPDSWGQGTLVTVSS

SEQ ID NO: 247 - DNA, 357 bp, ARTIFICIAL SEQUENCE
  Antibody
gaagttcaattgttagagtctggtggcggtcttgttcagcctggtggttctttacgtctttcttgcgctgcttccggattcactttctcttggtacggtatgaattgggttcgccaagctcctggtaaaggtttggagtgggtttcttctatctctccttctggtggccagactccttatgctgactccgttaaaggtcgcttcactatctctagagacaactctaagaatactctctacttgcagatgaacagcttaagggctgaggacacggccgtgtattactgtgcgcgagatctcggtggggcctacatacctgactcctggggccagggcaccctggtcaccgtctcaagc

SEQ ID NO: 248 - protein, 108 aa, ARTIFICIAL SEQUENCE
  Antibody
QDIQMTQSPSFLSASVGDRVTITCRASQGISNYLAWYQQEPGKAPKLLIYSASTLQTGVPSRFSGSGSGTEFTLTISSLQPEDFATYYCQQFNSYPRTFGHGTKVEFK

SEQ ID NO: 249 - DNA, 324 bp, ARTIFICIAL SEQUENCE
  Antibody
caagacatccagatgacccagtctccttccttcctgtctgcatctgtgggagacagagtcaccatcacttgccgggccagtcagggcattagcaattatttagcctggtatcagcaagaaccagggaaagcccctaagctcctcatctattctgcgtccactttgcaaactggagtcccatcaaggttcagcggcagtggatctgggacagagttcactctcacaatcagcagcctgcagcctgaggattttgcaacttattactgtcaacagtttaacagttaccctcgaacgttcggccacgggaccaaggtggaattcaaa

SEQ ID NO: 250 - protein, 118 aa, ARTIFICIAL SEQUENCE
  Antibody
EVQLLESGGGLVQPGGSLRLSCAASGFTFSTYPMMWVRQAPGKGLEWVSVISPSGGQTSYADSVKGRFTISRDNSKNTLYLQMNSLRAEDTAVYYCTRGGRLNAFDIWGQGTMVTVSS

SEQ ID NO: 251 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctacttaccctatgatgtgggttcgccaagctcctggtaaaggtttggagtgggtttctgttatctctccttctggtggccagacttcttatgctgactccgttaaaggtcgcttcactatctctagagacaactctaagaatactctctacttgcagatgaacagcttaagggctgaggacacagccgtgtattactgtacgagaggggggaggctgaatgcttttgatatctggggccaagggacaatggtcaccgtctcaagc

SEQ ID NO: 252 - protein, 107 aa, ARTIFICIAL SEQUENCE
  Antibody
QSALTQDPAVSVALGQTVRFTCQGDSLRNYHPSWYQQKPGQAPVLVIYGKNNRPSGIPDRFSGSSSGNTASLTITGAQAEDEADYYCNSRDSSGNHVFGTGTKVTVL

SEQ ID NO: 253 - DNA, 321 bp, ARTIFICIAL SEQUENCE
  Antibody
cagagcgctttgactcaggaccctgctgtgtctgtggccttgggacagacagtcaggttcacttgccaaggagacagcctcagaaattatcatccaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatgtcttcggaactgggaccaaggtcaccgtccta

SEQ ID NO: 254 - protein, 126 aa, ARTIFICIAL SEQUENCE
  Antibody
EVQLLESGGGLVQPGGSLRLSCAASGFTFSIYQMGWVRQAPGKGLEWVSRIYPSGGVTKYADSVKGRFTISRDNSKNTLYLQMNSLRAEDTAVYYCARDFGPGDLWSGYYDAFDIWGQGTMVTVSS

SEQ ID NO: 255 - DNA, 378 bp, ARTIFICIAL SEQUENCE
  Antibody
gaagttcaattgttagagtctggtggcggtcttgttcagcctggtggttctttacgtctttcttgcgctgcttccggattcactttctctatttaccagatgggttgggttcgccaagctcctggtaaaggtttggagtgggtttctcgtatctatccttctggtggcgttactaagtatgctgactccgttaaaggtcgcttcactatctctagagacaactctaagaatactctctacttgcagatgaacagcttaagggctgaggacacggctgtgtattactgtgccagagatttcggtccgggcgatttatggagtggttattatgatgcttttgatatctggggccaagggacaatggtcaccgtctcaagc

SEQ ID NO: 256 - protein, 110 aa, ARTIFICIAL SEQUENCE
  Antibody
QSALTQPASASGSPGQSVTISCTGTSSDVGGYNYVSWYQQHPGKAPKLMIYEVSKRPSGVPDRFSGSKSATTASLTVSGLQAEDEADYYCSSYAGSNNLIFGGGTKVTVL

SEQ ID NO: 257 - DNA, 330 bp, ARTIFICIAL SEQUENCE
  Antibody
cagagcgctttgactcagcctgcctccgcgtccgggtctcctggacagtcagtcaccatctcctgcactggaaccagcagtgacgttggtggttataactatgtctcctggtaccaacaacacccaggcaaagcccccaaactcatgatttatgaggtcagtaagcggccctcaggggtccctgatcgcttctctggctccaagtctgccaccacggcctccctgaccgtctctgggctccaggctgaggatgaggctgattattactgcagctcatatgcaggcagcaacaatttgatattcggcggggggaccaaggtgaccgtccta

SEQ ID NO: 258 - protein, 120 aa, ARTIFICIAL SEQUENCE
  Antibody
EVQLLESGGGLVQPGGSLRLSCAASGFTFSSYQMQWVRQAPGKGLEWVSVIYPGGYTYYADSVKGRFTISRDNSKNTLYLQMNSLRAEDTAVYYCARLQFYGSSAAFDIWGQGTMVTVSS

SEQ ID NO: 259 - DNA, 360 bp, ARTIFICIAL SEQUENCE
  Antibody
gaagttcaattgttagagtctggtggcggtcttgttcagcctggtggttctttacgtctttcttgcgctgcttccggattcactttctcttcttaccagatgcagtgggttcgccaagctcctggtaaaggtttggagtgggtttctgttatctatcctggtggctatacttattatgctgactccgttaaaggtcgcttcactatctctagagacaactctaagaatactctctacttgcagatgaacagcttaagggctgaggacacggccgtgtattactgtgcaagactccagttctacggttcctctgctgcttttgacatctggggccaagggacaatggtcaccgtctcaagc

SEQ ID NO: 260 - protein, 108 aa, ARTIFICIAL SEQUENCE
  Antibody
QDIQMTQSPDTLSLSPGERATLSCRASQSISRYLAWYQQRPGQAPSLLIYDASERAAGIPARFSGSGSGTDFTLTISSLEPEDFAVYYCQQRGNWPLTFGGGTKVDIR

SEQ ID NO: 261 - DNA, 324 bp, ARTIFICIAL SEQUENCE
  Antibody
caagacatccagatgacccagtctccagacaccctgtctttgtctccaggggaaagagccaccctctcctgcagggccagtcagagtattagtagatacttagcctggtaccaacaaagacctggccaggctcccagcctcctcatctatgatgcatccgaaagggccgctggcatcccagccaggttcagtggcagtgggtctgggacagacttcactctcaccatcagcagcctggagcctgaagattttgcagtttattactgtcagcaacgtggcaactggccgctcactttcggcggagggaccaaggtggacatcaga

SEQ ID NO: 262 - protein, 119 aa, ARTIFICIAL SEQUENCE
  Antibody
EVQLLESGGGLVQPGGSLRLSCAASGFTFSQYPMIWVRQAPGKGLEWVSVISPSGGHTSYADSVKGRFTISRDNSKNTLYLQMNSLRAEDTAVYYCARIQYYGGAFDIWGQGKMVTVSS

SEQ ID NO: 263 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctcagtaccctatgatttgggttcgccaagctcctggtaaaggtttggagtgggtttctgttatctctccttctggtggccatacttcttatgctgactccgttaaaggtcgcttcactatctctagagacaactctaagaatactctctacttgcagatgaacagcttaagggctgaggacacggccgtgtattactgtgcgagaatccagtactacggtggggcttttgatatctggggccaagggaaaatggtcaccgtctcaagc

SEQ ID NO: 264 - protein, 108 aa, ARTIFICIAL SEQUENCE
  Antibody
QDIQMTQSPATLSLSPGERATLSCRASQSVSSYLAWYQQKPGQAPRLLIYDASNRATGIPARFSGSGSGTDFTLTISSLEPEDFAVYYCQQRSNWPHTFGGGTKVEIK

SEQ ID NO: 265 - DNA, 324 bp, ARTIFICIAL SEQUENCE
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcacactttcggcggagggaccaaggtggagatcaaa

SEQ ID NO: 266 - protein, 118 aa, ARTIFICIAL SEQUENCE
  Antibody
EVQLLESGGGLVQPGGSLRLSCAASGFTFSPYGMLWVRQAPGKGLEWVSVISPSGGQTFYADSVKGRFTISRDNSKNTLYLQMNSLRAEDTAVYYCARLGAEKGMDVWGQGTTVTVSS

SEQ ID NO: 267 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctccttacggtatgctttgggttcgccaagctcctggtaaaggtttggagtgggtttctgttatctctccttctggtggccagactttttatgctgactccgttaaaggtcgcttcactatctctagagacaactctaagaatactctctacttgcagatgaacagcttaagggctgaggacacggccgtgtattactgtgcgaggctaggtgcggaaaaaggtatggacgtctggggccaagggaccacggtcaccgtctcaagc

SEQ ID NO: 268 - protein, 108 aa, ARTIFICIAL SEQUENCE
  Antibody
QDIQMTQSPATLSVSPGERATLSCRASQSVSSNLAWYQQRPGQAPRLLIYGASSRATGIPDRFSGSGSGTDFTLTISRLEPEDFAVYYCQQYGSSPRTFGQGTKVEIK

SEQ ID NO: 269 - DNA, 324 bp, ARTIFICIAL SEQUENCE
  Antibody
caagacatccagatgacccagtctccagccaccctgtctgtgtctccaggggaaagagccaccctctcctgcagggccagtcagagtgttagcagcaacttagcctggtaccagcagagacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaagggaccaaggtggaaatcaaa

SEQ ID NO: 270 - protein, 130 aa, ARTIFICIAL SEQUENCE
  Antibody
EVQLLESGGGLVQPGGSLRLSCAASGFTFSRYVMGWVRQAPGKGLEWVSSIYPSGGYTYYADSVKGRFTISRDNSKNTLYLQMNSLRAEDTAVYYCAKDSPHCSGGSCYGGYYYYGMDVWGQGTTVTVSS

SEQ ID NO: 271 - DNA, 390 bp, ARTIFICIAL SEQUENCE
  Antibody
gaagttcaattgttagagtctggtggcggtcttgttcagcctggtggttctttacgtctttcttgcgctgcttccggattcactttctctcgttacgttatgggttgggttcgccaagctcctggtaaaggtttggagtgggtttcttctatctatccttctggtggctatacttattatgctgactccgttaaaggtcgcttcactatctctagagacaactctaagaatactctctacttgcagatgaacagcttaagggctgaggacacggccgtgtattactgtgcgaaagattccccgcattgtagtggtggtagctgctacgggggctactactactacggtatggacgtctggggccaagggaccacggtcaccgtctcaagc

SEQ ID NO: 272 - protein, 110 aa, ARTIFICIAL SEQUENCE
  Antibody
QSELTQPASVSGSPGQSITISCTGTNRDVGGYNYVSWYQQHPGKAPKLMIYDVSNRPSGVSNRFSGSKSGNTASLTISGLQADDEAEYYCSSYTSSGTRVFGTGTKVTVL

SEQ ID NO: 273 - DNA, 330 bp, ARTIFICIAL SEQUENCE
  Antibody
cagagcgaattgactcagcctgcctccgtgtctgggtctcctggacagtcgatcaccatctcctgcactggaaccaacagagacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgacgacgaggctgagtattactgcagctcatatacaagcagcggcactcgagtcttcggaactgggaccaaggtcaccgtccta

SEQ ID NO: 274 - protein, 117 aa, ARTIFICIAL SEQUENCE
  Antibody
EVQLLESGGGLVQPGGSLRLSCAASGFTFSHYIMVWVRQAPGKGLEWVSSIYPSGGVTYYADSVKGRFTISRDNSKNTLYLQMNSLRAEDTAVYYCARDVAGALDYWGQGTLVTVSS

SEQ ID NO: 275 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctcattacattatggtttgggttcgccaagctcctggtaaaggtttggagtgggtttcttctatctatccttctggtggcgttacttattatgctgactccgttaaaggtcgcttcactatctctagagacaactctaagaatactctctacttgcagatgaacagcttaagggctgaggacacggccgtgtattactgtgcgagagatgttgccggagctcttgactactggggccagggaaccctggtcaccgtctcaagc

SEQ ID NO: 276 - protein, 110 aa, ARTIFICIAL SEQUENCE
  Antibody
QYELTQPASVSGSPGQSITISCTGTSTDVGGYNYVSWYQKHPGKAPKLMIYDVSNRPSGVSNRFSGSKSGNTASLTISGLQAEDEADYYCSSYTNTITVVFGGGTKLTVL

SEQ ID NO: 277 - DNA, 330 bp, ARTIFICIAL SEQUENCE
  Antibody
cagtacgaattgactcagcctgcctccgtgtctgggtctcctggacagtcgatcaccatctcctgcactggaaccagcactgacgttggtggttataactatgtctcctggtaccaaaaacacccaggcaaagcccccaaactcatgatttatgatgtcagtaaccggccctctggggtttctaatcgcttctctggctccaagtctggcaacacggcctccctgaccatctctgggctccaggctgaggacgaggctgactattactgcagctcatatacaaacaccatcaccgtggtgttcggcggagggaccaagctgaccgtccta

SEQ ID NO: 278 - protein, 122 aa, ARTIFICIAL SEQUENCE
  Antibody
EVQLLESGGGLVQPGGSLRLSCAASGFTFSKYWMHWVRQAPGKGLEWVSSIYSSGGRTHYADSVKGRFTISRDNSKNTLYLQMNSLRAEDTAMYYCAHTDSSTWYRWYFDLWGRGTLVTVSS

SEQ ID NO: 279 - DNA, 366 bp, ARTIFICIAL SEQUENCE
  Antibody
gaagttcaattgttagagtctggtggcggtcttgttcagcctggtggttctttacgtctttcttgcgctgcttccggattcactttctctaagtactggatgcattgggttcgccaagctcctggtaaaggtttggagtgggtttcttctatctattcttctggtggccgtactcattatgctgactccgttaaaggtcgcttcactatctctagagacaactctaagaatactctctacttgcagatgaacagcctaagggctgaggacaccgccatgtattactgtgcacacactgatagcagcacctggtaccggtggtacttcgatctctggggccgtggcaccctggtcaccgtctcaagc

SEQ ID NO: 280 - protein, 108 aa, ARTIFICIAL SEQUENCE
  Antibody
QDIQMTQSPSTLSSSVGDRVTITCRASQSVSNWLAWYQQKPGKAPKVLIYKASTLESGVPSRFSGSGSGTEFTLTISSLQPDDFATYYCQHYHRYSRTFGQGTKVEIK

SEQ ID NO: 281 - DNA, 324 bp, ARTIFICIAL SEQUENCE
  Antibody
caagacatccagatgacccagtctccttccaccctgtcttcatctgtaggagacagagtcaccatcacttgccgggccagtcagagtgttagtaactggttggcctggtatcagcagaaaccagggaaagcccctaaggtcctaatctataaggcgtctactttagaaagtggggtcccgtcaaggttcagcggcagtggatctgggacagaattcactctcaccatcagcagcctgcagcctgatgattttgcaacttattactgccaacattatcatcgttattctcgaacgttcggccaagggaccaaggtggaaatcaaa

SEQ ID NO: 282 - protein, 119 aa, ARTIFICIAL SEQUENCE
  Antibody
EVQLLESGGGLVQPGGSLRLSCAASGFTFSAYKMTWVRQAPGKGLEWVSSIYPSGGWTWYADSVKGRFTISRDNSKNTLYLQMNSLRAEDTAVYYCARDNWQGGAFDIWGQGTMVTVSS

SEQ ID NO: 283 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctgcttacaagatgacttgggttcgccaagctcctggtaaaggtttggagtgggtttcttctatctatccttctggtggctggacttggtatgctgactccgttaaaggtcgcttcactatctctagagacaactctaagaatactctctacttgcagatgaacagcttaagggctgaggacacggccgtgtattactgtgcgagagataactggcagggcggtgcttttgacatctggggccaagggacaatggtcaccgtctcaagc

SEQ ID NO: 284 - protein, 108 aa, ARTIFICIAL SEQUENCE
  Antibody
QDIQMTQSPGTLSLSPGERATLSCRASQSVNSNQLAWYQQKPGQAPRLLIYGASNRATGIPARFSGSGSGTDFTLTISSLEPEDFAVYYCQQRSNFWTFGQGTKVEIK

SEQ ID NO: 285 - DNA, 324 bp, ARTIFICIAL SEQUENCE
  Antibody
caagacatccagatgacccagtctccaggcaccctgtctttgtctccaggggaaagagccaccctctcctgcagggccagtcagagtgttaacagcaaccagttagcctggtaccagcagaaacctggccaggctcccaggctcctcatctatggtgcatccaacagggccactggcatcccagccaggttcagtggcagtgggtctgggacagacttcactctcaccatcagcagcctagagcctgaagattttgcagtctattactgtcagcagcgtagcaacttttggacgttcggccaagggaccaaggtggaaatcaaa

SEQ ID NO: 286 - protein, 125 aa, ARTIFICIAL SEQUENCE
  Antibody
EVQLLESGGGLVQPGGSLRLSCAASGFTFSRYLMMWVRQAPGKGLEWVSSIYPSGGWTYYADSVKGRFTISRDNSKNTLYLQMNSLRAEDTAMYYCARVAPYDSSGSVNYAFDPWGQGTLVTVSS

SEQ ID NO: 287 - DNA, 375 bp, ARTIFICIAL SEQUENCE
  Antibody
gaagttcaattgttagagtctggtggcggtcttgttcagcctggtggttctttacgtctttcttgcgctgcttccggattcactttctctcgttaccttatgatgtgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacaccgccatgtattactgtgccagagtcgccccctatgatagtagtggttcggtaaattacgcgttcgacccctggggccagggcaccctggtcaccgtctcaagc

SEQ ID NO: 288 - protein, 108 aa, ARTIFICIAL SEQUENCE
  Antibody
QDIQMTQSPSSLSASVGDRVTITCRASQNINIYLNWYQQKPGRAPSLLIYTQSNLRSGVPSRFSGSGYGTDFTLTISGLQPEDFATYYCQQSHSAPRTFGQGTRVEIK

SEQ ID NO: 289 - DNA, 324 bp, ARTIFICIAL SEQUENCE
  Antibody
caagacatccagatgacccagtctccatcctccctgtctgcatctgtaggagacagagtcaccatcacttgccgggcaagtcagaacattaacatctatttgaattggtatcagcagaagccagggagagcccctagcctcctgatttatactcaatccaatttgcgaagtggggtcccatcaaggttcagtggcagtggatatggcacagatttcactctcaccatcagcggtctgcaacctgaagattttgcaacttactactgtcaacagagtcacagtgccccccggacgttcggccaggggaccagggtggaaatcaaa

SEQ ID NO: 290 - protein, 123 aa, ARTIFICIAL SEQUENCE
  Antibody
EVQLLESGGGLVQPGGSLRLSCAASGFTFSHYKMVWVRQAPGKGLEWVSVIYPSGGWTRYADSVKGRFTISRDNSKNTLYLQMNSLRAEDTAVYYCAREMIDTISPGWHFDLWGRGTLVTVSS

SEQ ID NO: 291 - DNA, 369 bp, ARTIFICIAL SEQUENCE
  Antibody
gaagttcaattgttagagtctggtggcggtcttgttcagcctggtggttctttacgtctttcttgcgctgcttccggattcactttctctcattacaagatggtttgggttcgccaagctcctggtaaaggtttggagtgggtttctgttatctatccttctggtggctggactcgttatgctgactccgttaaaggtcgcttcactatctctagagacaactctaagaatactctctacttgcagatgaacagcttaagggctgaggacacggccgtgtattactgtgcaagagaaatgattgacactatttcgcccggctggcacttcgatctctggggccgtggcaccctggtcaccgtctcaagc

SEQ ID NO: 292 - protein, 109 aa, ARTIFICIAL SEQUENCE
  Antibody
QSELTQDPAVSVALGQTVRITCQGDSLRSYYASWYQQKPGQAPVLVMYGKNNRPSGIPDRFSGSSSGNTASLTITGAQAEDEADYYCQSRGSSSGNHYVFGTGTKVTVL

SEQ ID NO: 293 - DNA, 327 bp, ARTIFICIAL SEQUENCE
  Antibody
cagagcgaattgactcaggaccctgctgtgtctgtggccttgggacagacagtcaggatcacatgccaaggagacagcctcagaagctattatgcaagctggtaccagcagaagccaggacaggcccctgtacttgtcatgtatggtaaaaacaaccggccctcagggatcccagaccgattctctggctccagttcaggaaacacagcttccttgaccatcactggggctcaggcggaagatgaggctgactattactgtcagtcccggggcagcagcagtggtaaccattatgtcttcggaactgggaccaaggtcaccgtccta

SEQ ID NO: 294 - protein, 127 aa, ARTIFICIAL SEQUENCE
  Antibody
EVQLLESGGGLVQPGGSLRLSCAASGFTFSRYQMMWVRQAPGKGLEWVSSIYPSGGFTRYADSVKGRFTISRDNSKNILYLQMNSLRAEDTAVYYCAKSYYYGSGTYHYSYYGMDVWGQGTTVTVSS

SEQ ID NO: 295 - DNA, 381 bp, ARTIFICIAL SEQUENCE
  Antibody
gaagttcaattgttagagtctggtggcggtcttgttcagcctggtggttctttacgtctttcttgcgctgcttccggattcactttctctcgttaccagatgatgtgggttcgccaagctcctggtaaaggtttggagtgggtttcttctatctatccttctggtggctttactcgttatgctgactccgttaaaggtcgcttcactatctctagagacaactctaagaatattctctacttgcagatgaacagcttaagggctgaggacacggccgtatattactgtgcgaaatcatattactatgggtcggggacctatcattactcttactacggtatggacgtctggggccaagggaccacggtcaccgtctcaagc

SEQ ID NO: 296 - protein, 109 aa, ARTIFICIAL SEQUENCE
  Antibody
QDIQMTQSPGTLSLSPGERATLSCRASQSVSSTYLAWYQQKPGQAPRLLIYGASSRATGIPDRFTGSGSGTDFTLTISRLEPEDFAVYYCQHYGSSPLTFGGGTKVEIK

SEQ ID NO: 297 - DNA, 327 bp, ARTIFICIAL SEQUENCE
  Antibody
caagacatccagatgacccagtctccaggcaccttgtctttgtctccaggggaaagagccaccctctcctgcagggccagtcagagtgttagtagcacctacttagcctggtaccagcagaaacctggccaggctcccaggctcctcatctatggtgcatccagcagggccactggcatcccagacaggttcactggcagtgggtctgggacagacttcactctcaccatcagcagactggagcctgaagattttgcagtgtattactgtcagcactatggtagctcaccgctcactttcggcggagggaccaaggtggagatcaaa

SEQ ID NO: 298 - protein, 124 aa, ARTIFICIAL SEQUENCE
  Antibody
EVQLLESGGGLVQPGGSLRLSCAASGFTFSRYRMDWVRQAPGKGLEWVSGIYPSGGHTYYADSVKGRFTISRDNSKNTLYLQMNSLRAEDTATYYCARLYLWGSYPTQVAFDIWGQGTMVTVSS

SEQ ID NO: 299 - DNA, 372 bp, ARTIFICIAL SEQUENCE
  Antibody
gaagttcaattgttagagtctggtggcggtcttgttcagcctggtggttctttacgtctttcttgcgctgcttccggattcactttctctcgttaccgtatggattgggttcgccaagctcctggtaaaggtttggagtgggtttctggtatctatccttctggtggccatacttattatgctgactccgttaaaggtcgcttcactatctctagagacaactctaagaatactctctacttgcagatgaacagcttaagggctgaggacacagccacgtattactgtgcgagactttacctttgggggagttatcccacccaggttgcttttgatatctggggccaagggacaatggtcaccgtctcaagc

SEQ ID NO: 300 - protein, 108 aa, ARTIFICIAL SEQUENCE
  Antibody
QDIQMTQSPATLSVSPGERATLSCRASQSVSSNLAWYQQKPGQAPRLLIYGASTRATGIPARFSGSGSGTDFTLTISSLEPEDFAVYYCQQRSNWPLTFGGGTKVEIK

SEQ ID NO: 301 - DNA, 324 bp, ARTIFICIAL SEQUENCE
  Antibody
caagacatccagatgacccagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagacttcactctcaccatcagcagcctagagcctgaagattttgcagtttattactgtcagcagcgtagcaactggccgctcactttcggcggagggaccaaggtggagatcaaa

SEQ ID NO: 302 - protein, 122 aa, ARTIFICIAL SEQUENCE
  Antibody
EVQLLESGGGLVQPGGSLRLSCAASGFTFSMYPMLWVRQAPGKGLEWVSSIYPSGGMTYYADSVKGRFTISRDNSKNTLYLQMNSLRAEDTAVYYCARQGYYDSSGWTFDYWGQGTLVTVSS

SEQ ID NO: 303 - DNA, 366 bp, ARTIFICIAL SEQUENCE
  Antibody
gaagttcaattgttagagtctggtggcggtcttgttcagcctggtggttctttacgtctttcttgcgctgcttccggattcactttctctatgtaccctatgctttgggttcgccaagctcctggtaaaggtttggagtgggtttcttctatctatccttctggtggcatgacttattatgctgactccgttaaaggtcgcttcactatctctagagacaactctaagaatactctctacttgcagatgaacagcttaagggctgaggacacggccgtgtattactgtgcgagacaaggttactatgatagtagtgggtggacctttgactactggggccagggaaccctggtcaccgtctcaagc

SEQ ID NO: 304 - protein, 108 aa, ARTIFICIAL SEQUENCE
  Antibody
QDIQMTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 305 - DNA, 324 bp, ARTIFICIAL SEQUENCE
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgctcactttcggcggagggaccaaggtggagatcaaa

SEQ ID NO: 306 - protein, 119 aa, ARTIFICIAL SEQUENCE
  Antibody
EVQLLESGGGLVQPGGSLRLSCAASGFTFSAYVMNWVRQAPGKGLEWVSGIYSSGGYIYYADSVKGRFTISRDNSKNTLYLQMNSLRAEDTATYYCARRHFNGVGFDLWGQGTMVTVSS

SEQ ID NO: 307 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctgcttacgttatgaattgggttcgccaagctcctggtaaaggtttggagtgggtttctggtatctattcttctggtggctatatttattatgctgactccgttaaaggtcgcttcactatctctagagacaactctaagaatactctctacttgcagatgaacagcttaagggctgaggacacagccacatattactgtgcgagaagacatttcaacggggttggttttgatctctggggccaagggacaatggtcaccgtctcaagc

SEQ ID NO: 308 - protein, 105 aa, ARTIFICIAL SEQUENCE
  Antibody
QDIQMTQSPGTLSLSPGERATLSCRASQSVSSSNLAWYQQKPGQAPRLLIYGASTRATGIPARFSGSGSGTEFTLTISSLQSEDFAVYYCQLYKTFGGGTKVEIK

SEQ ID NO: 309 - DNA, 315 bp, ARTIFICIAL SEQUENCE
  Antibody
caagacatccagatgacccagtctccaggcaccctgtctttgtctccaggggaaagagccaccctctcctgcagggccagtcagagtgttagcagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagctgtataagactttcggcggagggaccaaggtggagatcaaa

SEQ ID NO: 310 - protein, 124 aa, ARTIFICIAL SEQUENCE
  Antibody
EVQLLESGGGLVQPGGSLRLSCAASGFTFSNYKMNWVRQAPGKGLEWVSVIYPSGGGTYYADSVKGRFTISRDNSKNTLYLQMNSLRAEDTAVYYCARVGYSSGWFLFYGMDVWGQGTTVTVSS

SEQ ID NO: 311 - DNA, 372 bp, ARTIFICIAL SEQUENCE
  Antibody
gaagttcaattgttagagtctggtggcggtcttgttcagcctggtggttctttacgtctttcttgcgctgcttccggattcactttctctaattacaagatgaattgggttcgccaagctcctggtaaaggtttggagtgggtttctgttatctatccttctggtggcggtacttattatgctgactccgttaaaggtcgcttcactatctctagagacaactctaagaatactctctacttgcagatgaacagcttaagggctgaggacacggctgtgtattactgtgcgagagtcgggtatagcagtggctggtttctcttttacggtatggacgtctggggccaagggaccacggtcaccgtctcaagc

SEQ ID NO: 312 - protein, 112 aa, ARTIFICIAL SEQUENCE
  Antibody
QSALTQPRSVSGSPGQSVTISCTGSNTDVGRYNFVSWYQQKPGKAPKLIIYDVYKRPSGVPDRFSGSKSGNTASLTISGLQADDEADYYCCSYARASTFSYVFGIGTEVTVL

SEQ ID NO: 313 - DNA, 336 bp, ARTIFICIAL SEQUENCE
  Antibody
cagagcgctttgactcagcctcgctcagtgtccgggtctcctggacagtcagtcaccatctcctgcactggatccaatactgatgttggtcgatacaattttgtttcctggtaccaacaaaagccaggcaaagcccccaaactcataatttatgatgtctataagcggccctcaggggtccctgatcgcttctctggctccaagtctggcaacacggcctccctgaccatctctgggctccaggctgacgatgaggctgattattactgctgctcatatgctcgcgcctccactttctcttatgtcttcggaattgggaccgaagtcaccgtcctt

SEQ ID NO: 314 - protein, 119 aa, ARTIFICIAL SEQUENCE
  Antibody
EVQLLESGGGLVQPGGSLRLSCAASGFTFSSYIMVWVRQAPGKGLEWVSSIYPSGGHTPYADSVKGRFTISRDNSKNTLYLQMNSLRAEDTAVYYCARQTGGYAHFDYWGQGTLVTVSS

SEQ ID NO: 315 - DNA, 357 bp, ARTIFICIAL SEQUENCE
  Antibody
gaagttcaattgttagagtctggtggcggtcttgttcagcctggtggttctttacgtctttcttgcgctgcttccggattcactttctcttcttacattatggtttgggttcgccaagctcctggtaaaggtttggagtgggtttcttctatctatccttctggtggccatactccttatgctgactccgttaaaggtcgcttcactatctctagagacaactctaagaatactctctacttgcagatgaacagcttaagggctgaggacacggccgtgtattactgtgcgagacagacgggtggctacgcccactttgattactggggccagggaaccctggtcaccgtctcaagc

SEQ ID NO: 316 - protein, 108 aa, ARTIFICIAL SEQUENCE
  Antibody
QDIQMTQSPSSLSASVGDRVTMTCRASQGIGTYLAWYQQKPGKVPKLLIYAASTLQSGVPSRFSGSGSGTDFTLTISSLQPEDVATYYCQKYNSAPRPFGQGTQVEIK

SEQ ID NO: 317 - DNA, 324 bp, ARTIFICIAL SEQUENCE
  Antibody
caagacatccagatgacccagtctccgtcctccctgtctgcatctgtaggagacagagtcaccatgacttgccgggcgagtcagggcattggcacttatttagcctggtatcagcagaaaccagggaaagttcctaagctcctgatctatgctgcgtccactttgcaatcaggggtcccatctcggttcagtggcagtggatctgggacggatttcactctcaccatcagcagcctgcagcctgaagatgttgcaacttattactgtcaaaagtataacagtgcccctcgtccgttcggccaagggacccaggtggaaatcaaa

SEQ ID NO: 318 - protein, 116 aa, ARTIFICIAL SEQUENCE
  Antibody
EVQLLESGGGLVQPGGSLRLSCAASGFTFSSYVMHWVRQAPGKGLEWVSSIYPSGGWTLYADSVKGRFTISRDNSKNTLYLQMNSLRAEDTAVYYCARAVGPFDYWGQGTLVTVSS

SEQ ID NO: 319 - DNA, 348 bp, ARTIFICIAL SEQUENCE
  Antibody
gaagttcaattgttagagtctggtggcggtcttgttcagcctggtggttctttacgtctttcttgcgctgcttccggattcactttctcttcttacgttatgcattgggttcgccaagctcctggtaaaggtttggagtgggtttcttctatctatccttctggtggctggactctttatgctgactccgttaaaggtcgcttcactatctctagagacaactctaagaatactctctacttgcagatgaacagcttaagggctgaggacacggccgtgtattactgtgcgagagcagtgggaccttttgactactggggccagggcaccctggtcaccgtctcaagc

SEQ ID NO: 320 - protein, 109 aa, ARTIFICIAL SEQUENCE
  Antibody
QYELIQPPSVSGIPGQRVTISCSGNNSNFGSNTVTWYQQLPGTAPKLLIYSDSRRPSGVPDRFSGSRSDTSASLAISGLQSEDEAEYHCAAWDDSLNGVFGGGTKLTVL

SEQ ID NO: 321 - DNA, 327 bp, ARTIFICIAL SEQUENCE
  Antibody
cagtacgaattgattcagccaccctcagtgtctgggatccccggacagagggtcaccatctcttgttctggaaacaactccaacttcggaagtaatactgtaacctggtaccagcagctcccaggaacggcccccaaactcctcatctatagtgatagtcggcggccctcaggggtccctgaccgattctctggctccaggtctgacacctcagcctccctggccatcagtgggctccagtctgaggatgaggctgagtatcactgtgcagcatgggatgacagcctaaatggggtgttcggcggagggaccaagctgaccgtccta

SEQ ID NO: 322 - protein, 126 aa, ARTIFICIAL SEQUENCE
  Antibody
EVQLLESGGGLVQPGGSLRLSCAASGFTFSRYKMEWVRQAPGKGLEWVSVIYPSGGHTNYADSVKGRFTISRDNSKNTLYLQMNSLRAEDTAVYYCARGGYYDILTGYYKYYFDYWGQGTLVTVSS

SEQ ID NO: 323 - DNA, 378 bp, ARTIFICIAL SEQUENCE
  Antibody
gaagttcaattgttagagtctggtggcggtcttgttcagcctggtggttctttacgtctttcttgcgctgcttccggattcactttctctcgttacaagatggagtgggttcgccaagctcctggtaaaggtttggagtgggtttctgttatctatccttctggtggccatactaattatgctgactccgttaaaggtcgcttcactatctctagagacaactctaagaatactctctacttgcagatgaacagcttaagggctgaggacacggccgtgtattactgtgcgagaggaggctattacgatattttgactggttattataagtactactttgactactggggccagggaaccctggtcaccgtctcaagc

SEQ ID NO: 324 - protein, 109 aa, ARTIFICIAL SEQUENCE
  Antibody
QDIQMTQSPSPLSASVGDSVTITCRASQRIGSYLNWYQQNPGKAPKLLIYGASNLESGVPSRFSGRGSGTEFTLTITSLQPEDFATYFCQQTSSVSPLTFGQGTRLDIK

SEQ ID NO: 325 - DNA, 327 bp, ARTIFICIAL SEQUENCE
  Antibody
caagacatccagatgacccagtctccatcccccctgtctgcatctgtaggagacagtgtcaccatcacttgtcgggcaagtcagaggattggcagctacttgaattggtatcagcagaatccaggcaaagccccaaaactcctgatctacggtgcatccaatttggaaagtggggtcccatcaaggttcagtggccgtggatctgggacagagttcacactcaccatcaccagtctgcaacctgaagattttgcaacttatttctgtcaacagacctccagtgtctccccgctcaccttcggccaagggacacgactggacattaaa

SEQ ID NO: 326 - protein, 127 aa, ARTIFICIAL SEQUENCE
  Antibody
EVQLLESGGGLVQPGGSLRLSCAASGFTFSSYKMSWVRQAPGKGLEWVSVIYPSGGWTWYADSVKGRFTISRDNSKNTLYLQMNSLRAEDTAVYYCARMMYYYDSSGYLRADAFDIWGQGTMVTVSS

SEQ ID NO: 327 - DNA, 381 bp, ARTIFICIAL SEQUENCE
  Antibody
gaagttcaattgttagagtctggtggcggtcttgttcagcctggtggttctttacgtctttcttgcgctgcttccggattcactttctcttcttacaagatgtcttgggttcgccaagctcctggtaaaggtttggagtgggtttctgttatctatccttctggtggctggacttggtatgctgactccgttaaaggtcgcttcactatctctagagacaactctaagaatactctctacttgcagatgaacagcttaagggctgaggacacggccgtgtattactgtgcgagaatgatgtattactatgatagtagtggttacctaagggctgatgcttttgatatctggggccaagggacaatggtcaccgtctcaagc

SEQ ID NO: 328 - protein, 109 aa, ARTIFICIAL SEQUENCE
  Antibody
QDIQMTQSPGTLSTSIGDRVTITCRASQSINEWLAWYQQKPGKAPKLLIYAASSLQSGVPSRFSGSGSGTDFTLTISRLEPEDFAVYYCQQYGSSPALTFGGGTKVEIK

SEQ ID NO: 329 - DNA, 327 bp, ARTIFICIAL SEQUENCE
  Antibody
caagacatccagatgacccagtctccaggcaccctctctacatctataggagacagagtcaccatcacttgccgggccagtcagagtattaatgagtggttggcctggtatcagcagaaaccagggaaagcccctaagctcctgatctatgctgcatccagtttgcaaagtggggtcccatcaaggttcagtggcagtggatctgggacagacttcactctcaccatcagcagactggagcctgaagattttgcagtgtattactgtcagcagtatggtagctcacccgcgctcactttcggcggagggaccaaggtggagatcaaa

SEQ ID NO: 330 - protein, 119 aa, ARTIFICIAL SEQUENCE
  Antibody
EVQLLESGGGLVQPGGSLRLSCAASGFTFSAYKMMWVRQAPGKGLEWVSSIYPSGGWTYYADSVKGRFTISRDNSKNTLYLQMNSLRAEDTALYYCARSMGYGDAFDIWGQGTMVTVSS

SEQ ID NO: 331 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctgcttacaagatgatgtgggttcgccaagctcctggtaaaggtttggagtgggtttcttctatctatccttctggtggctggacttattatgctgactccgttaaaggtcgcttcactatctctagagacaactctaagaatactctctacttgcagatgaacagtttaagggctgaggacaccgccttgtattactgtgcgagatcaatgggctatggtgatgcttttgatatctggggccaagggacaatggtcaccgtctcaagc

SEQ ID NO: 332 - protein, 109 aa, ARTIFICIAL SEQUENCE
  Antibody
QDIQMTQSPSSLSASVGDRVTITCRASQTIRSYLNWYQQKPGKAPKLLIYAASNLQSGVPSRFSGSGSGTDFTLTISSLQPEDFATYYCQQSYSMSSWTFGQGTNLEIK

SEQ ID NO: 333 - DNA, 327 bp, ARTIFICIAL SEQUENCE
  Antibody
caagacatccagatgacccagtctccatcctccctgtctgcatctgtaggagacagagtcacaatcacttgccgggcaagtcagaccattagaagctatttaaattggtatcagcagaaaccagggaaagcccctaagctcctgatctatgctgcatccaatttgcaaagtggggtcccatcaaggttcagtggcagtgggtctgggacagacttcactctcaccatcagcagtctgcaacctgaagattttgcaacttactactgtcaacagagttacagtatgtcgtcgtggacttttggccaggggaccaacctggagatcaaa

SEQ ID NO: 334 - protein, 118 aa, ARTIFICIAL SEQUENCE
  Antibody
EVQLLESGGGLVQPGGSLRLSCAASGFTFSVYPMAWVRQAPGKGLEWVSWISPGGKTYYADSVKGRFTISRDNSKNTLYLQMNSLRAEDTATYYCARGSRHYDKFDYWGQGTLVTVSS

SEQ ID NO: 335 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctgtttaccctatggcttgggttcgccaagctcctggtaaaggtttggagtgggtttcttggatctctcctggtggcaagacttattatgctgactccgttaaaggtcgcttcactatctctagagacaactctaagaatactctctacttgcagatgaacagcttaagggctgaggacacagccacgtattactgtgcgagagggagccgccactatgataagtttgactactggggccagggaaccctggtcaccgtctcaagc

SEQ ID NO: 336 - protein, 110 aa, ARTIFICIAL SEQUENCE
  Antibody
QSVLTQPASVSGSPGQSITISCTGTSSDVGGYNYVSWYQQHPGKAPKVMIYDVSNRPSGVSNRFSGSKSGNTASLTISGLLAEDEADYYCSSYTSTATYVLGTGTRVTVV

SEQ ID NO: 337 - DNA, 330 bp, ARTIFICIAL SEQUENCE
  Antibody
cagagcgtcttgactcagcctgcctccgtgtctgggtctcctggacagtcgatcaccatctcctgcactggaaccagcagtgacgttggtggttacaactatgtctcctggtaccaacaacacccaggcaaagcccccaaagtcatgatttatgatgtcagtaatcggccctcaggggtttctaatcgcttctctggctccaagtctggcaacacggcctccctgaccatctcggggctcctggctgaggacgaagctgattattactgcagctcatatacaagtacagccacctatgtcctcggaactgggaccagggtcaccgtcgta

SEQ ID NO: 338 - protein, 118 aa, ARTIFICIAL SEQUENCE
  Antibody
EVQLLESGGGLVQPGGSLRLSCAASGFTFSHYKMAWVRQAPGKGLEWVSVIYPSGGATYYADSVKGRFTISRDNSKNTLYLQMNSLRAEDTAVYYCARALPGGYFDYWGQGTLVTVSS

SEQ ID NO: 339 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctcattacaagatggcttgggttcgccaagctcctggtaaaggtttggagtgggtttctgttatctatccttctggtggcgctacttattatgctgactccgttaaaggtcgcttcactatctctagagacaactctaagaatactctctacttgcagatgaacagcttaagggctgaggacacggccgtgtattactgtgcaagggccttaccggggggctactttgactactggggccagggcaccctggtcaccgtctcaagc

SEQ ID NO: 340 - protein, 109 aa, ARTIFICIAL SEQUENCE
  Antibody
QDIQMTQSPGTLSLSPGERATLACRASQSVSSSYLAWYQQKPGQAPRLLIYGASNRATGIPDRFSGSGSDTDFTLKISRVEAEDVGTYYCMQATFWPYAFGQGTKLEIK

SEQ ID NO: 341 - DNA, 327 bp, ARTIFICIAL SEQUENCE
  Antibody
caagacatccagatgacccagtctccaggcaccctgtctttgtctccaggggaaagagccaccctcgcctgcagggccagtcagagtgttagcagcagctacttagcctggtaccagcagaaacctggccaggctcccaggctcctcatctatggtgcatccaacagggccactggcatcccagacagattcagcggcagtgggtcagacactgatttcacactgaaaatcagcagggtggaggctgaggatgttgggacttattactgcatgcaagctacattctggccgtacgcttttggccaggggaccaagctggagatcaaa

SEQ ID NO: 342 - protein, 126 aa, ARTIFICIAL SEQUENCE
  Antibody
EVQLLESGGGLVQPGGSLRLSCAASGFTFSWYRMVWVRQAPGKGLEWVSGIYPSGGFTSYADSVKGRFTISRDNSKNTLYLQMNSLRAEDTAVYYCARVYYYDSSGYYFRGGFDPWGQGTLVTVSS

SEQ ID NO: 343 - DNA, 378 bp, ARTIFICIAL SEQUENCE
  Antibody
gaagttcaattgttagagtctggtggcggtcttgttcagcctggtggttctttacgtctttcttgcgctgcttccggattcactttctcttggtaccgtatggtttgggttcgccaagctcctggtaaaggtttggagtgggtttctggtatctatccttctggtggctttacttcttatgctgactccgttaaaggtcgcttcactatctctagagacaactctaagaatactctctacttgcagatgaacagcttaagggctgaggacacggccgtgtattactgtgcgagagtgtattactatgatagtagtggttattatttccgtggggggttcgacccctggggccagggcaccctggtcaccgtctcaagc

SEQ ID NO: 344 - protein, 109 aa, ARTIFICIAL SEQUENCE
  Antibody
QSVLTQPPSVSGIPGQRVTISCSGNNSNFGSNTVTWYQQLPGTAPKLLIYSDSRRPSGVPDRFSGSRSDTSASLAISGLQSEDEAEYHCAAWDDSLNGVFGGGTKLTVL

SEQ ID NO: 345 - DNA, 327 bp, ARTIFICIAL SEQUENCE
  Antibody
cagagcgtcttgactcagccaccctcagtgtctgggatccccggacagagggtcaccatctcttgttctggaaacaactccaacttcggaagtaatactgtaacctggtaccagcagctcccaggaacggcccccaaactcctcatctatagtgatagtcggcggccctcaggggtccctgaccgattctctggctccaggtctgacacctcagcctccctggccatcagtgggctccagtctgaggatgaggctgagtatcactgtgcagcatgggatgacagcctaaatggggtgttcggcggagggaccaagctgaccgtccta

SEQ ID NO: 346 - protein, 121 aa, ARTIFICIAL SEQUENCE
  Antibody
EVQLLESGGGLVQPGGSLRLSCAASGFTFSQYLMQWVRQAPGKGLEWVSSIYPSGGATYYADSVKGRFTISRDNSKNTLYLQMNSLRAEDTAVYYCATRKDGYSRSAFDIWGQGTMVTVSS

SEQ ID NO: 347 - DNA, 363 bp, ARTIFICIAL SEQUENCE
  Antibody
gaagttcaattgttagagtctggtggcggtcttgttcagcctggtggttctttacgtctttcttgcgctgcttccggattcactttctctcagtaccttatgcagtgggttcgccaagctcctggtaaaggtttggagtgggtttcttctatctatccttctggtggcgctacttattatgctgactccgttaaaggtcgcttcactatctctagagacaactctaagaatactctctacttgcagatgaacagcttaagggctgaggacacggccgtgtattactgtgcaacaaggaaggatggctacagtcgaagtgcttttgatatctggggccaagggacaatggtcaccgtctcaagc

SEQ ID NO: 348 - protein, 109 aa, ARTIFICIAL SEQUENCE
  Antibody
QDIQMTQSPGTLSLSPGERATLSCRASQSVSSSYLAWYQQKPGQAPRLLIYGASSRATGIPDRFSGSGSGTDFTLTISRLEPEDFAVYYCQQRGNWPRTFGQGTKVEIK

SEQ ID NO: 349 - DNA, 327 bp, ARTIFICIAL SEQUENCE
  Antibody
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagcgtggcaactggccccggacgttcggccaagggaccaaggtggaaatcaaa

SEQ ID NO: 350 - protein, 118 aa, ARTIFICIAL SEQUENCE
  Antibody
EVQLLESGGGLVQPGGSLRLSCAASGFTFSHYVMWWVRQAPGKGLEWVSGIYPSGWTVYADSVKGRFTISRDNSKNTLYLQMNSLRAEDTAVYYCAKDLGGTRAFDYWGQGTLVTVSS

SEQ ID NO: 351 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctcattacgttatgtggtgggttcgccaagctcctggtaaaggtttggagtgggtttctggtatctatccttctggttggactgtttatgctgactccgttaaaggtcgcttcactatctctagagacaactctaagaatactctctacttgcagatgaacagcttaagggctgaggacacggccgtgtattactgtgcgaaagatctgggggggacccgtgcctttgactactggggccagggaaccctggtcaccgtctcaagc

SEQ ID NO: 352 - protein, 110 aa, ARTIFICIAL SEQUENCE
  Antibody
QSELTQPASVSGSPGQSITISCTGTSSDDVGGYNYVSWYQQHPGKAPKLLIYDVSDRPSGVSNRFSGSKSGNTASLTISGLLAEDEADYYCGSYRVTSVSRSYVFGTETK

SEQ ID NO: 353 - DNA, 330 bp, ARTIFICIAL SEQUENCE
  Antibody
cagagcgaattgactcagcctgcctccgtgtctgggtctcctggacagtcgatcaccatctcctgcactggaaccagcagtgacgacgttggtggttataactatgtctcctggtaccaacaacacccaggcaaagcccccaaactcctgatttatgatgtcagtgatcggccctcaggggtttctaatcgcttctctggctccaagtctggcaacacggcctccctgaccatctctgggctcctggctgaggacgaggctgattattattgcggctcatatcgcgtcaccagcgtcagcagatcctatgtcttcggaactgagaccaag

SEQ ID NO: 354 - protein, 117 aa, ARTIFICIAL SEQUENCE
  Antibody
EVQLLESGGGLVQPGGSLRLSCAASGFTFSNYPMTWVRQAPGKGLEWVSRIYPSGGYTYYADSVKGRFTISRDNSKNTLYLQMNSLRAEDTAVYYCARGRIAALDYWGQGTLVTVSS

SEQ ID NO: 355 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctaattaccctatgacttgggttcgccaagctcctggtaaaggtttggagtgggtttctcgtatctatccttctggtggctatacttattatgctgactccgttaaaggtcgcttcactatctctagagacaactctaagaatactctctacttgcagatgaacagcttaagggctgaggacacggccgtgtattactgtgcgaggggtcgtatagcagctcttgactactggggccagggcaccctggtcaccgtctcaagc

SEQ ID NO: 356 - protein, 107 aa, ARTIFICIAL SEQUENCE
  Antibody
QSALTQGPTVSVALGQTVRITCQGDTLRYFSASWYQQKPGQAPVLVIFGANNRPSGIPDRFSGSRSGVTASLTITGAQAEDEAEYYCNSRDGSGNWLFGGGTKLSVL

SEQ ID NO: 357 - DNA, 321 bp, ARTIFICIAL SEQUENCE
  Antibody
cagagcgctttgactcagggccctactgtgtctgtggccttgggacagacagtcaggatcacatgtcaaggagacaccctcagatacttttctgcaagttggtaccagcagaagccgggacaggcccctgtccttgtcatctttggggcaaacaatcggccctcagggatcccagaccggttctctggctccaggtcaggagtcaccgcttccttgaccatcactggggctcaggcggaagatgaggctgagtattactgtaactcccgggacggcagtggtaattggctgttcggcggagggaccaagctgtccgtcctc

SEQ ID NO: 358 - protein, 124 aa, ARTIFICIAL SEQUENCE
  Antibody
EVQLLESGGGLVQPGGSLRLSCAASGFTFSRYVMHWVRQAPGKGLEWVSVIYPSGGATLYADSVKGRFTISRDNSKNTLYLQMNSLRAEDTAVYYCARGQYSSGWYTEGWFDPWGQGTLVTVSS

SEQ ID NO: 359 - DNA, 372 bp, ARTIFICIAL SEQUENCE
  Antibody
gaagttcaattgttagagtctggtggcggtcttgttcagcctggtggttctttacgtctttcttgcgctgcttccggattcactttctctcgttacgttatgcattgggttcgccaagctcctggtaaaggtttggagtgggtttctgttatctatccttctggtggcgctactctttatgctgactccgttaaaggtcgcttcactatctctagagacaactctaagaatactctctacttgcagatgaacagcttaagggctgaggacacggccgtgtattactgtgcgagaggccagtatagcagtggctggtacacggagggctggttcgacccctggggccagggcaccctggtcaccgtctcaagc

SEQ ID NO: 360 - protein, 110 aa, ARTIFICIAL SEQUENCE
  Antibody
QYELTQPPSASGTPGQRVTISCSGSSSNIGSNNVNWYQQLPGTAPKLLIYSNDQRPSGVPDRFSGSKSATSASLAISGLQSEDEADYHCAAWDDSLNGPVFGGGTKLTVL

SEQ ID NO: 361 - DNA, 330 bp, ARTIFICIAL SEQUENCE
  Antibody
cagtacgaattgactcagccaccctcagcgtctgggacccccgggcagagggtcaccatctcttgttctggaagcagctccaacatcggaagtaataatgtcaactggtaccagcaactcccaggaacggcccccaaactcctcatctacagtaatgatcagcggccctcaggggtccctgaccgattctctggctccaagtctgccacctcagcctccctggccatcagtgggctccagtctgaggatgaggctgattatcactgtgcagcatgggatgacagcctgaatggtccggtgttcggcggagggaccaagctgaccgtccta

SEQ ID NO: 362 - protein, 119 aa, ARTIFICIAL SEQUENCE
  Antibody
EVQLLESGGGLVQPGGSLRLSCAASGFTFSRYKMQWVRQAPGKGLEWVSSIYPSGGITYYADSVKGRFTISRDNSKNTLYLQMNSLRAEDTAVYYCARGRGTTRAFDYWGQGTLVTVSS

SEQ ID NO: 363 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctcgttacaagatgcagtgggttcgccaagctcctggtaaaggtttggagtgggtttcttctatctatccttctggtggcattacttattatgctgactccgttaaaggtcgcttcactatctctagagacaactctaagaatactctctacttgcagatgaacagcttaagggctgaggacacggccgtgtattactgtgcgagaggacgaggaacgacgcgggcttttgactactggggccagggaaccctggtcaccgtctcaagc

SEQ ID NO: 364 - protein, 108 aa, ARTIFICIAL SEQUENCE
  Antibody
QYELTQPPSVSVAPGQTAKILCGGNDIGRKFVHWYQQKPGQAPVLVVFDDSDRPSGIPERFSGSNSGSTATLTISGVEAGDEADYFCQVWDLSSDHWVFGGGTKLTVL

SEQ ID NO: 365 - DNA, 324 bp, ARTIFICIAL SEQUENCE
  Antibody
cagtacgaattgactcagccaccctcggtgtcagtggccccaggacagacggccaagattctctgtgggggaaacgacattggaagaaagtttgttcactggtaccagcagaagccaggccaggcccctgtgctggtcgtctttgatgatagcgaccggccctcagggatccctgagcgattctctggctccaattctgggagcacggccaccctgaccatcagcggggtcgaagccggggatgaggccgactatttctgtcaggtgtgggatcttagtagtgatcattgggtgttcggcggagggaccaagctgaccgtccta

SEQ ID NO: 366 - protein, 125 aa, ARTIFICIAL SEQUENCE
  Antibody
EVQLLESGGGLVQPGGSLRLSCAASGFTFSDYAMHWVRQAPGKGLEWVSRIGSSGGHTSYADSVKGRFTISRDNSKNTLYLQMNSLRAEDTAMYYCATDYYYDSSGYYYPAFDIWGQGTMVTVSS

SEQ ID NO: 367 - DNA, 375 bp, ARTIFICIAL SEQUENCE
  Antibody
gaagttcaattgttagagtctggtggcggtcttgttcagcctggtggttctttacgtctttcttgcgctgcttccggattcactttctctgattacgctatgcattgggttcgccaagctcctggtaaaggtttggagtgggtttctcgtatcggttcttctggtggccatacttcttatgctgactccgttaaaggtcgcttcactatctctagagacaactctaagaatactctctacttgcagatgaacagcttaagggctgaggacaccgccatgtattactgtgcgactgactattactatgatagtagtggttattactaccctgcttttgatatctggggccaagggacaatggtcaccgtctcaagc

SEQ ID NO: 368 - protein, 108 aa, ARTIFICIAL SEQUENCE
  Antibody
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPLFGGGTKVEIK

SEQ ID NO: 369 - DNA, 324 bp, ARTIFICIAL SEQUENCE
  Antibody
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctctgttcggcggagggaccaaggtggagatcaaa

SEQ ID NO: 370 - protein, 119 aa, ARTIFICIAL SEQUENCE
  Antibody
EVQLLESGGGLVQPGGSLRLSCAASGFTFSRYAMMWVRQAPGKGLEWVSSIYPSGGSTYYADSVKGRFTISRDNSKNTLYLQMNSLRAEDTAVYYCARVQGGAGAFDIWGQGTMVTVSS

SEQ ID NO: 371 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctcgttacgctatgatgtgggttcgccaagctcctggtaaaggtttggagtgggtttcttctatctatccttctggtggctctacttattatgctgactccgttaaaggtcgcttcactatctctagagacaactctaagaatactctctacttgcagatgaacagcttaagggctgaggacacggccgtgtattactgtgcgagagtacaggggggggcgggtgcttttgatatctggggccaagggacaatggtcaccgtctcaagc

SEQ ID NO: 372 - protein, 109 aa, ARTIFICIAL SEQUENCE
  Antibody
QDIQMTQSPSSLSASVGDRVTITCRASQSINTYLNWYQHKPGKAPELLISAASSLQSGVPSRFSGSGSGTDFTLTISSLRPEDFATYYCQQSHSISTFTFGPGTKVDVK

SEQ ID NO: 373 - DNA, 327 bp, ARTIFICIAL SEQUENCE
  Antibody
caagacatccagatgacccagtctccatcttccctgtctgcatctgtcggagacagagtcaccatcacttgccgggcaagtcagagcattaacacctatttaaattggtatcagcacaaaccagggaaggcccctgagctcctgatctctgctgcatctagcttgcaaagtggggtcccatcaaggttcagtggcagtggatctgggacagatttcactctcaccatcagcagtctgcgacctgaagattttgcgacttactactgtcaacagagtcacagtatatccacattcactttcggccctgggaccaaagtggatgtcaag

SEQ ID NO: 374 - protein, 126 aa, ARTIFICIAL SEQUENCE
  Antibody
EVQLLESGGGLVQPGGSLRLSCAASGFTFSRYKMHWVRQAPGKGFEWVSSIVPSGGWTYYADSVKGRFTISRDNSKNTLYLQMNSLRAEDTAVYYCARQMYYYDSSGYYVGRFDIWGQGTTVTVSS

SEQ ID NO: 375 - DNA, 378 bp, ARTIFICIAL SEQUENCE
  Antibody
gaagttcaattgttagagtctggtggcggtcttgttcagcctggtggttctttacgtctttcttgcgctgcttccggattcactttctctcgttacaagatgcattgggttcgccaagctcctggtaaaggttttgagtgggtttcttctatcgttccttctggtggctggacttattatgctgactccgttaaaggtcgcttcactatctctagagacaactctaagaatactctctacttgcagatgaacagcttaagggctgaggacacggccgtgtattactgtgcgagacaaatgtattactatgatagtagtggttattatgtcgggcgttttgatatctggggccaagggaccacggtcaccgtctcaagc

SEQ ID NO: 376 - protein, 110 aa, ARTIFICIAL SEQUENCE
  Antibody
QDIQMTQSPATLSLSPGERATLSCRASQSVSSYLAWYQQKPGQAPRLLIYDASNRATGIPARFSGSGSGTDFTLTISSLEPEDFAVYYCQQRSNWPPRITFGGGTKVEIK

SEQ ID NO: 377 - DNA, 330 bp, ARTIFICIAL SEQUENCE
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccccggatcactttcggcggagggaccaaggtggagatcaaa

SEQ ID NO: 378 - protein, 123 aa, ARTIFICIAL SEQUENCE; identical to SEQ ID NO: 238
  Antibody

SEQ ID NO: 379 - DNA, 369 bp, ARTIFICIAL SEQUENCE; identical to SEQ ID NO: 239
  Antibody

SEQ ID NO: 380 - protein, 110 aa, ARTIFICIAL SEQUENCE
  Antibody
QDIQMTQSPATLSLSPGERATLSCRASQSVSSSYLAWYQQKPGQAPRLLIYGASSRATGIPDRFSGSGSGTDFTLTISRLEPEDFAVYYCQQYGSSPQLTFGGGTKVEIK

SEQ ID NO: 381 - DNA, 330 bp, ARTIFICIAL SEQUENCE
  Antibody
caagacatccagatgacccagtctccagccaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccccagctcactttcggcggagggaccaaggtggagatcaaa

SEQ ID NO: 382 - protein, 118 aa, ARTIFICIAL SEQUENCE
  Antibody
EVQLLESGGGLVQPGGSLRLSCAASGFTFSNYKMWWVRQAPGKGLEWVSSIYPSGGWTQYADSVKGRFTISRDNSKNTLYLQMNSLRAEDTAVYYCAKDVGGGGFDYWGQGTLVTVSS

SEQ ID NO: 383 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctaattacaagatgtggtgggttcgccaagctcctggtaaaggtttggagtgggtttcttctatctatccttctggtggctggactcagtatgctgactccgttaaaggtcgcttcactatctctagagacaactctaagaatactctctacttgcagatgaacagcttaagggctgaggacactgccgtgtattactgtgcgaaagatgttggggggggtggctttgactactggggccagggaaccctggtcaccgtctcaagc

SEQ ID NO: 384 - protein, 104 aa, ARTIFICIAL SEQUENCE
  Antibody
QDIQMTQSPATLSVSPGERATLSCRASQSVSSNLAWYQQKPGQAPRLLIYGASTRATGIPARFSGSGSGTEFTLTISSLQSEDFAVYYCLTRVTFGGGTKVELK

SEQ ID NO: 385 - DNA, 312 bp, ARTIFICIAL SEQUENCE
  Antibody
caagacatccagatgacccagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagaattcactctcaccatcagcagcctgcagtctgaagattttgcagtttattactgtctaacacgagtcactttcggcggagggaccaaggttgagctcaag

SEQ ID NO: 386 - protein, 130 aa, ARTIFICIAL SEQUENCE
  Antibody
EVQLLESGGGLVQPGGSLRLSCAASGFTFSHYKMGWVRQAPGKGLEWVSSIYPSGGWTTYADSVKGRFTISRDNSKNTLYLQMNSLRAEDTAVYYCARDSPLVVPAAIKSGAYYYGMDVWGQGTTVTVSS

SEQ ID NO: 387 - DNA, 390 bp, ARTIFICIAL SEQUENCE
  Antibody
gaagttcaattgttagagtctggtggcggtcttgttcagcctggtggttctttacgtctttcttgcgctgcttccggattcactttctctcattacaagatgggttgggttcgccaagctcctggtaaaggtttggagtgggtttcttctatctatccttctggtggctggactacttatgctgactccgttaaaggtcgcttcactatctctagagacaactctaagaatactctctacttgcagatgaacagcttaagggctgaggacacggccgtgtattactgtgcgagagattcccccctagtagtaccagctgctattaagagcggggcctactactacggtatggacgtctggggccaagggaccacggtcaccgtctcaagc

SEQ ID NO: 388 - protein, 110 aa, ARTIFICIAL SEQUENCE
  Antibody
QSVLTQPPSASGTPGQRVSISCSGSSYNIGVYDVYWYQQLPGTAPKLLIYTNNQRPSGVPDRFSGSKSGTSASLSISGLRSEDEADYYCAAWDDSLAGWVFGGGTKVTVL

SEQ ID NO: 389 - DNA, 330 bp, ARTIFICIAL SEQUENCE
  Antibody
cagagcgtcttgactcagccaccctcagcgtctgggacccccgggcagagggtcagtatctcttgttctggaagcagctacaacatcggagtttatgatgtatactggtaccagcagctcccaggaacggcccccaaactcctcatctataccaataatcagcggccctcaggggtccctgaccgattctctggctccaagtctggcacctcagcctccctgtccatcagtgggctccggtccgaggatgaggctgattattactgtgcagcctgggatgacagcctggctggttgggtgttcggcggagggaccaaggtgaccgtccta

SEQ ID NO: 390 - protein, 117 aa, ARTIFICIAL SEQUENCE
  Antibody
EVQLLESGGGLVQPGGSLRLSCAASGFTFSRYVMLWVRQAPGKGLEWVSVIYPSGGYTYYADSVKGRFTISRDNSKNTLYLQMNSLRAEDTAVYYCARGVLRAFDIWGQGTMVTVSS

SEQ ID NO: 391 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctcgttacgttatgctttgggttcgccaagctcctggtaaaggtttggagtgggtttctgttatctatccttctggtggctatacttattatgctgactccgttaaaggtcgcttcactatctctagagacaactctaagaatactctctacttgcagatgaacagcttaagggctgaggacacggccgtgtattactgtgcgagaggggtactaagagcttttgatatctggggccaagggacaatggtcaccgtctcaagc

SEQ ID NO: 392 - protein, 108 aa, ARTIFICIAL SEQUENCE
  Antibody
QDIQMTQSPATLSLSPGERATLSCRASQSVSSYLAWYQQKPGQAPRLLIYDTSNRATGIPARFSGSGSGTDFTLTISSLEPEDFAVYYCQQRSNWPITFGQGTRLEIK

SEQ ID NO: 393 - DNA, 324 bp, ARTIFICIAL SEQUENCE
  Antibody
caagacatccagatgacccagtctccagccaccctgtctttgtctccgggggaaagagccaccctctcctgcagggccagtcagagtgttagcagctacttagcctggtaccaacagaaacctggccaggctcccaggctcctcatctatgatacatccaacagggccactggcatcccagccaggttcagtggcagtgggtctgggacagacttcactctcaccatcagcagtctagagcctgaagattttgcagtttattactgtcagcagcgtagcaactggccgatcaccttcggccaagggacacgactggagattaaa

SEQ ID NO: 394 - protein, 119 aa, ARTIFICIAL SEQUENCE
  Antibody
EVQLLESGGGLVQPGGSLRLSCAASGFTFSGYGMYWVRQAPGKGLEWVSVISPSGGYTHYADSVKGRFTISRDNSKNTLYLQMNSLRAEDTAVYYCARAYSSGWYLDYWGQGTLVTVSS

SEQ ID NO: 395 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctggttacggtatgtattgggttcgccaagctcctggtaaaggtttggagtgggtttctgttatctctccttctggtggctatactcattatgctgactccgttaaaggtcgcttcactatctctagagacaactctaagaatactctctacttgcagatgaacagcttaagggctgaggacacggccgtgtattactgtgcgagagcgtatagcagtggctggtaccttgactactggggccagggaaccctggtcaccgtctcaagc

SEQ ID NO: 396 - protein, 106 aa, ARTIFICIAL SEQUENCE
  Antibody
QSVLTQPPSLSVSPGQTARIACSGDNLGSRYISWYQQKSGQSPVVVLYQDYRRPSGIPERISGSNSGNTATLTISGTQAVDEADYYCQAWDRSTAVFGGGTRLTVL

SEQ ID NO: 397 - DNA, 318 bp, ARTIFICIAL SEQUENCE
  Antibody
cagagcgtcttgactcagccaccctcactgtccgtgtccccagggcagacagcccgcatcgcctgctctggagataatttggggagtagatatatttcctggtatcagcagaagtcaggccagtctcctgtggtggtcctctatcaagactacagacggccctcagggatccctgagcgaatctctggctccaactctgggaacacagccactctgaccatcagcgggactcaggctgtggatgaggcggactattattgtcaggcgtgggacagaagcactgcggtgttcggcggagggaccaggctgaccgtccta

SEQ ID NO: 398 - protein, 123 aa, ARTIFICIAL SEQUENCE; identical to SEQ ID NO: 238
  Antibody

SEQ ID NO: 399 - DNA, 369 bp, ARTIFICIAL SEQUENCE; identical to SEQ ID NO: 239
  Antibody

SEQ ID NO: 400 - protein, 109 aa, ARTIFICIAL SEQUENCE
  Antibody
QDIQMTQSPDTLSLSPGERATLSCRASHSVTNNRLAWYQQKPGQSPRLLIYGASNRAAGIPARFSGSGSGTDFTLTISSLEPEDFAVYYCQQRSHWLYTFGQGTKLEIK

SEQ ID NO: 401 - DNA, 327 bp, ARTIFICIAL SEQUENCE
  Antibody
caagacatccagatgacccagtctccagacaccctgtctttgtctccaggagaaagagccaccctctcatgcagggccagtcacagtgttactaacaaccgcttagcctggtaccagcagaaacctggccagtctcccaggctcctcatctatggtgcatccaacagggccgctggcatccctgccaggttcagtggcagtggctctgggacagacttcactctcaccatcagcagcctagagcctgaagattttgcagtttattactgtcaacagcgtagccactggctttacacttttggccaggggaccaagctggagatcaaa

SEQ ID NO: 402 - protein, 119 aa, ARTIFICIAL SEQUENCE
  Antibody
EVQLLESGGGLVQPGGSLRLSCAASGFTFSSYIMIWVRQAPGKGLEWVSSIYPSGGQTYYADSVKGRFTISRDNSKNTLYLQMNSLRAEDMAVYYCARKNGYNNVFDVWGQGTMVTVSS

SEQ ID NO: 403 - DNA, 357 bp, ARTIFICIAL SEQUENCE
  Antibody
gaagttcaattgttagagtctggtggcggtcttgttcagcctggtggttctttacgtctttcttgcgctgcttccggattcactttctcttcttacattatgatttgggttcgccaagctcctggtaaaggtttggagtgggtttcttctatctatccttctggtggccagacttattatgctgactccgttaaaggtcgcttcactatctctagagacaactctaagaatactctctacttgcagatgaacagcttaagggctgaggacatggctgtgtattactgtgcaagaaaaaatggctacaataatgtatttgatgtctggggccaagggacaatggtcaccgtctcaagc

SEQ ID NO: 404 - protein, 110 aa, ARTIFICIAL SEQUENCE
  Antibody
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTYVFGTGTKVTVL

SEQ ID NO: 405 - DNA, 330 bp, ARTIFICIAL SEQUENCE
  Antibody
cagagcgctttgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcacttatgtcttcggaactgggaccaaggtcaccgtccta

SEQ ID NO: 406 - protein, 123 aa, ARTIFICIAL SEQUENCE
  Antibody
EVQLLESGGGLVQPGGSLRLSCAASGFTFSRYPMLWVRQAPGKGLEWVSSIYPSGGWTSYADSVKGRFTISRDNSKNTLYLQMNSLRAEDTAVYYCTTPTHNWNDDPDAFDIWGQGTTVTVSS

SEQ ID NO: 407 - DNA, 369 bp, ARTIFICIAL SEQUENCE
  Antibody
gaagttcaattgttagagtctggtggcggtcttgttcagcctggtggttctttacgtctttcttgcgctgcttccggattcactttctctcgttaccctatgctttgggttcgccaagctcctggtaaaggtttggagtgggtttcttctatctatccttctggtggctggacttcttatgctgactccgttaaaggtcgcttcactatctctagagacaactctaagaatactctctacttgcagatgaacagcttaagggctgaggacacagccgtgtattactgtaccacccctacccacaactggaacgatgaccctgatgcttttgatatctggggccaagggaccacggtcaccgtctcaagc

SEQ ID NO: 408 - protein, 107 aa, ARTIFICIAL SEQUENCE
  Antibody
QSVLTQPPSVSVAPGQTATITCGGNNIGTKSVHWYQQKPGQAPVFVYDDNDRPSGIPERFSGSNSGNTATMTISRVEAGDEADYYCQVWDPTGDQYVFGSGTKVTVL

SEQ ID NO: 409 - DNA, 321 bp, ARTIFICIAL SEQUENCE
  Antibody
cagagcgtcttgactcagccaccctcggtgtcagtggccccaggacagacggccacgattacctgtgggggaaacaacattggaactaaaagtgtacactggtaccagcagaagccaggccaggcccctgtcttcgtctatgatgataatgaccggccctcagggatccctgagcgattctctggctccaactccgggaacacggccaccatgaccatcagcagggtcgaagccggggatgaggccgactattattgtcaggtgtgggatcctactggtgatcagtatgtcttcggaagtgggaccaaggtcaccgtccta

SEQ ID NO: 410 - protein, 123 aa, ARTIFICIAL SEQUENCE
  Antibody
EVQLLESGGGLVQPGGSLRLSCAASGFTFSKYKMLWVRQAPGKGLEWVSVIYPSGGYTYYADSVKGRFTISRDNSKNTLYLQMNSLRAEDTAVYYCARVVVPAFYYYYYMDVWGKGTTVTVSS

SEQ ID NO: 411 - DNA, 369 bp, ARTIFICIAL SEQUENCE
  Antibody
gaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttctgttatctatccttctggtggctatacttactatgctgactccgttaaaggtcgcttcactatctctagagacaactctaagaatactctctacttgcagatgaacagcttaagggctgaggacacggccgtgtattactgtgcgagagtagtagtaccagctttctactactactactacatggacgtctggggcaaagggaccacggtcaccgtctcaagc

SEQ ID NO: 412 - protein, 112 aa, ARTIFICIAL SEQUENCE
  Antibody
QSELTQPASVSGSPGQSITISCTGTSSDVGGYNYVSWYQQHPGKAPKLMIYEVSNRPSGVSNRFSGSKSGNTASLTISGLQAEDEADYYCSSYTSSSTLGGVFGGGTKLTVL

SEQ ID NO: 413 - DNA, 336 bp, ARTIFICIAL SEQUENCE
  Antibody
cagagcgaattgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctcgggggggtattcggcggagggaccaagctgaccgtccta

SEQ ID NO: 414 - protein, 117 aa, ARTIFICIAL SEQUENCE
  Antibody
EVQLLESGGGLVQPGGSLRLSCAASGFTFSKYKMDWVRQAPGKGLEWVSSIYPSGGFTYYADSVKGRFTISRDNSKNTLYLQMNSLRAEDTAVYYCAREKMATMDYWGQGTLVTVSS

SEQ ID NO: 415 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctaagtacaagatggattgggttcgccaagctcctggtaaaggtttggagtgggtttcttctatctatccttctggtggctttacttattatgctgactccgttaaaggtcgcttcactatctctagagacaactctaagaatactctctacttgcagatgaacagcttaagggctgaggacacggccgtgtattactgtgcaagagagaagatggctacaatggactactggggccagggcaccctggtcaccgtctcaagc

SEQ ID NO: 416 - protein, 109 aa, ARTIFICIAL SEQUENCE
  Antibody
QYELTQPASVSGSPGQSITISCTGTSSDVGGCNYVSWYQQHPGKAPQLLIYDVSYRPSGVSNRFSGSKSGNTASLTISGLQADDEADYYCSSCTSSSTLFGTGTKVTVL

SEQ ID NO: 417 - DNA, 327 bp, ARTIFICIAL SEQUENCE
  Antibody
cagtacgaattgactcaacctgcctccgtgtctgggtctcctggacagtcgatcaccatctcctgcactggaaccagcagtgacgttggtggttgtaactatgtctcctggtaccaacaacacccaggcaaagccccccaactcttgatttatgatgtcagttatcggccctcaggggtttctaatcgcttctctggctccaagtctggcaacacggcctccctgaccatctctgggctccaggctgacgacgaggctgattactactgcagctcatgtacaagtagcagcactctcttcggaactgggaccaaggtcaccgtccta

SEQ ID NO: 418 - protein, 119 aa, ARTIFICIAL SEQUENCE
  Antibody
EVQLLESGGGLVQPGGSLRLSCAASGFTFSRYVMHWVRQAPGKGLEWVSRIYPSGGWTYYADSVKGRFTISRDNSKNTLYLQMNSLRAEDTAVYYCARVAGESNGMDVWGQGTTVTVSS

SEQ ID NO: 419 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctcgttacgttatgcattgggttcgccaagctcctggtaaaggtttggagtgggtttctcgtatctatccttctggtggctggacttattatgctgactccgttaaaggtcgcttcactatctctagagacaactctaagaatactctctacttgcagatgaacagcttaagggctgaggacacggccgtgtattactgtgcgagagtggctggggagtcgaacggtatggacgtctggggccaagggaccacggtcaccgtctcaagc

SEQ ID NO: 420 - protein, 108 aa, ARTIFICIAL SEQUENCE
  Antibody
QDIQMTQSPSSLSASIGDRVTVTCRTSQSIDTYLNWYQQKPGQAPNLLIYGASSLESGVPSRFSGSGSGTDFTLTISSLQPEDFATYYCQQSYTTSYTFGRGTTLEIQ

SEQ ID NO: 421 - DNA, 324 bp, ARTIFICIAL SEQUENCE
  Antibody
caagacatccagatgacccagtctccatcctccctgtcagcatctataggagacagagtcaccgtcacttgccggacaagtcagagcattgacacctatttaaattggtatcagcaaaaaccagggcaagcccctaacctcctgatctatggtgcatccagtttggaaagtggggtcccatcaaggttcagtggcagtggatctgggacagatttcactctcaccatcagcagtctgcaacctgaagattttgcaacttactactgtcaacagagttacactacctcctacacttttggccgggggaccacgctggagatccaa

SEQ ID NO: 422 - protein, 126 aa, ARTIFICIAL SEQUENCE
  Antibody
EVQLLESGGGLVQPGGSLRLSCAASGFTFSIYKMQWVRQAPGKGLEWVSSIYPSGGATYYADSVKGRFTISRDNSKNTLYLQMNSLRAEDTAVYYCARQTYYYDSSGYFRNAFDIWGQGTMVTVSS

SEQ ID NO: 423 - DNA, 378 bp, ARTIFICIAL SEQUENCE
  Antibody
gaagttcaattgttagagtctggtggcggtcttgttcagcctggtggttctttacgtctttcttgcgctgcttccggattcactttctctatttacaagatgcagtgggttcgccaagctcctggtaaaggtttggagtgggtttcttctatctatccttctggtggcgctacttattatgctgactccgttaaaggtcgcttcactatctctagagacaactctaagaatactctctacttgcagatgaacagcttaagggctgaggacacggccgtgtattactgtgcgagacaaacgtattactatgatagtagtggttatttccgcaatgcttttgatatctggggccaagggacaatggtcaccgtctcaagc

SEQ ID NO: 424 - protein, 105 aa, ARTIFICIAL SEQUENCE
  Antibody
QSVLTQAASVSGSPGQSITLSCTGATRDVSWYQQHPGKAPKLVLYEVNSRPSDVSDRFSGSMSGNTASLTISGLQAEDEADYYCSSTTSRAPRVIFGGGTKLTVL

SEQ ID NO: 425 - DNA, 315 bp, ARTIFICIAL SEQUENCE
  Antibody
cagagcgtcttgactcaggctgcctccgtgtctgggtctcctggacagtcgatcaccctctcctgcactggagccaccagggacgtctcctggtaccaacaacacccaggcaaggcccccaaactcgtcctttatgaagtcaatagtcgcccctcagacgtttccgatcgcttctctggctccatgtctggcaacacggcctccctgaccatctctggactccaggctgaagacgaggctgattattactgctcctcaaccacaagtcgcgcccctcgcgtgattttcggcggagggaccaaactgaccgtccta

SEQ ID NO: 426 - protein, 121 aa, ARTIFICIAL SEQUENCE
  Antibody
EVQLLESGGGLVQPGGSLRLSCAASGFTFSRYRMVWVRQAPGKGLEWVSWIYPSGGWTSYADSVKGRFTISRDNSKNTLYLQMNSLRAEDTAVYYCARSNYYDSAATLDIWGQGTMVTVSS

SEQ ID NO: 427 - DNA, 363 bp, ARTIFICIAL SEQUENCE
  Antibody
gaagttcaattgttagagtctggtggcggtcttgttcagcctggtggttctttacgtctttcttgcgctgcttccggattcactttctctcgttaccgtatggtttgggttcgccaagctcctggtaaaggtttggagtgggtttcttggatctatccttctggtggctggacttcttatgctgactccgttaaaggtcgcttcactatctctagagacaactctaagaatactctctacttgcagatgaacagcttaagggctgaggacacggccgtgtattactgtgcgaggtcaaattactatgatagtgctgcgactcttgatatctggggccaagggacaatggtcaccgtctcaagc

SEQ ID NO: 428 - protein, 107 aa, ARTIFICIAL SEQUENCE
  Antibody
QDIQMTQSPSSLSASVGDRVTITCRASQTISSYLNWYQQKPGKAPKLLISAASTLQSGVPSRFSGSGSGTDFTLTISSLQPEDFATYYCQQSYSTPSFGQGTKVEIK

SEQ ID NO: 429 - DNA, 321 bp, ARTIFICIAL SEQUENCE
  Antibody
caagacatccagatgacccagtctccatcctccctgtctgcatctgtaggagacagagtcaccatcacttgccgggcaagtcagaccattagcagctatttaaattggtatcagcagaaaccagggaaagcccctaagctcctgatctctgctgcatccactttgcaaagtggggtcccatcaaggttcagtggcagtggatctgggacagatttcactctcaccatcagcagtctgcaacctgaagattttgcaacttactactgtcaacagagttacagtaccccctcgttcggccaagggaccaaggtggaaatcaaa

SEQ ID NO: 430 - protein, 126 aa, ARTIFICIAL SEQUENCE
  Antibody
EVQLLESGGGLVQPGGSLRLSCAASGFTFSHYQMLWVRQAPGKGLEWVSSIYPSGGWTYYADSVKGRFTISRDNSKNTLYLQMNSLRAEDTAVYYCARVGYSSGWYALTSKTFDYWGQGTLVTVSS

SEQ ID NO: 431 - DNA, 378 bp, ARTIFICIAL SEQUENCE
  Antibody
gaagttcaattgttagagtctggtggcggtcttgttcagcctggtggttctttacgtctttcttgcgctgcttccggattcactttctctcattaccagatgctttgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacacggccgtgtattactgtgcgagagtggggtatagcagtggctggtacgcgttgacttcaaagacttttgactactggggccagggaaccctggtcaccgtctcaagc

SEQ ID NO: 432 - protein, 106 aa, ARTIFICIAL SEQUENCE
  Antibody
QDIQMTQSPATLSLSPGDRAILSCRASHNIDNFLAWYQQKPGQAPRLLIYDASHRATGIPPRFSGSGSGTDFTLTISSLEPEDFAVYFCQQRTNWLFGGGTKVEIK

SEQ ID NO: 433 - DNA, 318 bp, ARTIFICIAL SEQUENCE
  Antibody
caagacatccagatgacccagtctccagccaccctgtctttgtctccgggggatcgagccatcctctcctgtagggccagtcacaatattgacaacttcttagcctggtatcaacagaaacctggccaggctcccaggctcctcatctatgatgcatctcatagggccactggcatccccccccggttcagtggcagtgggtctgggacagacttcactctcaccatcagcagcctagaacctgaagattttgctgtgtatttctgtcaacaacggaccaactggcttttcggcggagggaccaaggtggagatcaaa

SEQ ID NO: 434 - protein, 117 aa, ARTIFICIAL SEQUENCE
  Antibody
EVQLLESGGGLVQPGGSLRLSCAASGFTFSRYPMNWVRQAPGKGLEWVSRIWPSGGSTVYADSVKGRFTISRDNSKNTLYLQMNSLRAEDTAVYYCARDSSRYFDVWGRGTLVTVSS

SEQ ID NO: 435 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctcgttaccctatgaattgggttcgccaagctcctggtaaaggtttggagtgggtttctcgtatctggccttctggtggctctactgtttatgctgactccgttaaaggtcgcttcactatctctagagacaactctaagaatactctctacttgcagatgaacagcttaagggctgaggacacggccgtgtattactgtgcgagagattcttctcgatacttcgatgtctggggccgtggcaccctggtcaccgtctcaagc

SEQ ID NO: 436 - protein, 108 aa, ARTIFICIAL SEQUENCE
  Antibody
QDIQMTQSPATLSVSPGERATLSCRASQSISSNLAWYQQKPGQAPRLLIYGTSTRATGIPARFSGSGSGTEFTLTISSLQSEDFVVYYCQQYKDWPLTFGGGTTVEIK

SEQ ID NO: 437 - DNA, 324 bp, ARTIFICIAL SEQUENCE
  Antibody
caagacatccagatgacccagtctccagccaccctgtctgtgtctccaggggaaagagccaccctctcctgcagggccagtcagagtattagcagtaatttagcctggtaccaacaaaaacctggccaggctcccaggctcctcatctatggtacatccaccagggccactggtatcccagccaggttcagtggcagtgggtctgggaccgagttcactctcaccatcagcagcctgcagtctgaagattttgtagtttattactgtcagcagtataaagactggcctctcactttcggcggagggaccacggtggagatcaag

SEQ ID NO: 438 - protein, 117 aa, ARTIFICIAL SEQUENCE
  Antibody
EVQLLESGGGLVQPGGSLRLSCAASGFTFSNYKMHWVRQAPGKGLEWVSVIYPSGGVTEYADSVKGRFTISRDNSKNTLYLQMNSLRAEDTAVYYCARDQYSGHDYWGQGTLVTVSS

SEQ ID NO: 439 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctaattacaagatgcattgggttcgccaagctcctggtaaaggtttggagtgggtttctgttatctatccttctggtggcgttactgagtatgctgactccgttaaaggtcgcttcactatctctagagacaactctaagaatactctctacttgcagatgaacagcttaagggctgaggacacggccgtgtattactgtgcgagagatcaatacagtggccatgactactggggccagggaaccctggtcaccgtctcaagc

SEQ ID NO: 440 - protein, 108 aa, ARTIFICIAL SEQUENCE
  Antibody
QDIQMTQSPGTLSLSPGERATLSCRASQSVSSYLAWYQQKPGQAPRLLIYDASNRATGIPARFSGSGSGTDFTLTISSLEPEDFAVYYCQQRYSWPLTFGGGTKVEIK

SEQ ID NO: 441 - DNA, 324 bp, ARTIFICIAL SEQUENCE
  Antibody
caagacatccagatgacccagtctccaggcaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgttacagctggcctctcactttcggcggagggaccaaggtggagatcaag

SEQ ID NO: 442 - protein, 117 aa, ARTIFICIAL SEQUENCE
  Antibody
EVQLLESGGGLVQPGGSLRLSCAASGFTFSEYQMIWVRQAPGKGLEWVSYIVPSGGFTAYADSVKGRFTISRDNSKNTLYLQMNSLRAEDTAVYYCARVNYYGMDVWGQGTTVTVSS

SEQ ID NO: 443 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctgagtaccagatgatttgggttcgccaagctcctggtaaaggtttggagtgggtttcttatatcgttccttctggtggctttactgcttatgctgactccgttaaaggtcgcttcactatctctagagacaactctaagaatactctctacttgcagatgaacagcttaagggctgaggacacggccgtgtattactgtgcgagagtgaactactacggtatggacgtctggggccaagggaccacggtcaccgtctcaagc

SEQ ID NO: 444 - protein, 110 aa, ARTIFICIAL SEQUENCE
  Antibody
QSALTQPASVSGSPGQSISISCTGTNTDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 445 - DNA, 330 bp, ARTIFICIAL SEQUENCE
  Antibody
cagagcgctttgactcagcctgcctccgtgtctgggtctcctggacagtcgatcagcatctcctgcactggaaccaacactgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagtagtagcacttgggtgttcggcggagggaccaagctgaccgtccta

SEQ ID NO: 446 - protein, 127 aa, ARTIFICIAL SEQUENCE
  Antibody
EVQLLESGGGLVQPGGSLRLSCAASGFTFSAYLMEWVRQAPGKGLEWVSGIYPSGGKTYYADSVKGRFTISRDNSKNTLYLQMNSLRAEDTAVYYCARVNVISVAGTGYYYYGMDVWGQGTTVTVSS

SEQ ID NO: 447 - DNA, 381 bp, ARTIFICIAL SEQUENCE
  Antibody
gaagttcaattgttagagtctggtggcggtcttgttcagcctggtggttctttacgtctttcttgcgctgcttccggattcactttctctgcttaccttatggagtgggttcgccaagctcctggtaaaggtttggagtgggtttctggtatctatccttctggtggcaagacttattatgctgactccgttaaaggtcgcttcactatctctagagacaactctaagaatactctctacttgcagatgaacagcttaagggctgaggacacggccgtgtattactgtgcgagagtgaacgttatatcagtggctggtactggctactactactacggtatggacgtctggggccaagggaccacggtcaccgtctcaagc

SEQ ID NO: 448 - protein, 108 aa, ARTIFICIAL SEQUENCE
  Antibody
QDIQMTQSPATLSLSPGERATLSCRASQSVSIYLAWYQQKPGQAPRLLIYDASNRATDIPARFSGSGSGTDFTLTISSLEPEDFAVYYCQQRSSWPITFGLGTRLEIK

SEQ ID NO: 449 - DNA, 324 bp, ARTIFICIAL SEQUENCE
  Antibody
caagacatccagatgacccagtctccagccaccctgtctttgtctccaggggaaagagccaccctctcctgcagggccagtcagagtgttagcatctacttagcctggtaccaacagaaacctggtcaggctcccaggctcctcatctatgatgcatccaacagggccactgacatcccagccaggttcagtggcagtgggtctgggacagacttcactctcaccatcagcagcctagagcctgaagattttgcagtttattactgtcagcaacgtagcagctggccgatcaccttcggccttgggacacgactggagattaaa

SEQ ID NO: 450 - protein, 119 aa, ARTIFICIAL SEQUENCE; identical to SEQ ID NO: 262
  Antibody

SEQ ID NO: 451 - DNA, 357 bp, ARTIFICIAL SEQUENCE; identical to SEQ ID NO: 263
  Antibody

SEQ ID NO: 452 - protein, 108 aa, ARTIFICIAL SEQUENCE
  Antibody
QDIQMTQSPSSLSASVGDGVTITCRASQSINNHLNWYQQKPGKAPKVLIYAASSLQSGVPSRFSGSGSGTDFTLTISSLQPEDFATYYCQQSYSTPWTFGQGTKVEIK

SEQ ID NO: 453 - DNA, 324 bp, ARTIFICIAL SEQUENCE
  Antibody
caagacatccagatgacccagtctccatcctccctgtctgcatctgtaggagacggagtcaccatcacttgccgggcaagtcagagcattaacaaccatttaaattggtatcagcagaaaccagggaaagcccctaaggtcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtggacgttcggccaagggaccaaggtggaaatcaaa

SEQ ID NO: 454 - protein, 127 aa, ARTIFICIAL SEQUENCE
  Antibody
EVQLLESGGGLVQPGGSLRLSCAASGFTFSKYRMSWVRQAPGKGLEWVSGIYPSGGGTTYADSVKGRFTISRDNSKNTLYLQMNSLRAEDTAVYYCARPTYYYDSSGYYYSGPIDYWGQGTLVTVSS

SEQ ID NO: 455 - DNA, 381 bp, ARTIFICIAL SEQUENCE
  Antibody
gaagttcaattgttagagtctggtggcggtcttgttcagcctggtggttctttacgtctttcttgcgctgcttccggattcactttctctaagtaccgtatgtcttgggttcgccaagctcctggtaaaggtttggagtgggtttctggtatctatccttctggtggcggtactacttatgctgactccgttaaaggtcgcttcactatctctagagacaactctaagaatactctctacttgcagatgaacagcttaagggctgaggacacggccgtgtattactgtgcgagacccacgtattactatgatagtagtggttattactactcggggcctattgactactggggccagggaaccctggtcaccgtctcaagc

SEQ ID NO: 456 - protein, 110 aa, ARTIFICIAL SEQUENCE
  Antibody
QYELTQPASVSGSPGQSITISCTGTNTDVGGYNLVSWYQQHPGKAPKLIIYEVSNRPSGVSNRFSGSKSGNTASLTISGLQAEDEVDYYCGSYTSSSTHVFGSGTKVTVL

SEQ ID NO: 457 - DNA, 330 bp, ARTIFICIAL SEQUENCE
  Antibody
cagtacgaattgactcagcctgcctccgtgtctgggtctcctggacagtcgatcaccatctcctgcactggaaccaacactgacgttggtggttataaccttgtctcctggtaccaacagcacccaggcaaagcccccaaactcataatttatgaggtcagtaatcggccctcaggggtttctaatcgcttctctggctccaagtctggcaacacggcctccctgaccatctctgggctccaggctgaggacgaggttgattattattgcggctcatatacaagcagcagtactcatgtcttcggaagtgggaccaaggtcaccgtccta

SEQ ID NO: 458 - protein, 117 aa, ARTIFICIAL SEQUENCE
  Antibody
EVQLLESGGGLVQPGGSLRLSCAASGFTFSAYKMHWVRQAPGKGLEWVSVIYPSGGWTYYADSVKGRFTISRDNSKNTLYLQMNSLRAEDTAVYYCARGTAGWFDPWGQGTLVTVSS

SEQ ID NO: 459 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctgcttacaagatgcattgggttcgccaagctcctggtaaaggtttggagtgggtttctgttatctatccttctggtggctggacttattatgctgactccgttaaaggtcgcttcactatctctagagacaactctaagaatactctctacttgcagatgaacagcttaagggctgaggacacggccgtgtattactgtgcaagagggactgcagggtggttcgacccttggggccagggaaccctggtcaccgtctcaagc

SEQ ID NO: 460 - protein, 110 aa, ARTIFICIAL SEQUENCE
  Antibody
QSELTQPASVSGSPGQSITISCTGTSSDVGSYNLVSWYQQHPGKAPKLMIYEGSKRPSGVSNRFSGSKSGNTASLTISGLQAEDEADYYCCSYAGSSTYVFGTGTKVTVL

SEQ ID NO: 461 - DNA, 330 bp, ARTIFICIAL SEQUENCE
  Antibody
cagagcgaattgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcacttatgtcttcggaactgggaccaaggtcaccgtccta

SEQ ID NO: 462 - protein, 117 aa, ARTIFICIAL SEQUENCE
  Antibody
EVQLLESGGGLVQPGGSLRLSCAASGFTFSNYKMTWVRQAPGKGLEWVSSIYPSGGWTYYADSVKGRFTISRDNSKNTLYLQMNSLRAEDTAMYYCARQEDGGYGTWGQGTLVTVSS

SEQ ID NO: 463 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctaattacaagatgacttgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacaccgccatgtattactgtgcgagacaggaggatggtggctacgggacttggggccagggaaccctggtcaccgtctcaagc

SEQ ID NO: 464 - protein, 108 aa, ARTIFICIAL SEQUENCE
  Antibody
QSVLTQDPAVSVALGQTVRITCQGDSLRSYYATWYQQKPGQAPVLVIYGENNRPSGIPDRFSGSSSGNTGSLTITGAQAEDEADYYCNSRDTSGSHLLFGGGTKLTVL

SEQ ID NO: 465 - DNA, 324 bp, ARTIFICIAL SEQUENCE
  Antibody
cagagcgtcttgactcaggaccctgctgtgtctgtggccttgggacagacagtcaggatcacatgccaaggagacagcctcagaagctattatgcaacctggtaccaacagaagccaggacaggcccctgtacttgtcatctatggtgaaaacaaccggccctcagggatcccagaccgattctctggctccagttcaggaaacacaggttccttgaccatcactggggctcaggcggaagatgaggctgactattactgtaactcccgggacaccagtggtagtcatctattattcggcggagggaccaagctgaccgtcctg

SEQ ID NO: 466 - protein, 125 aa, ARTIFICIAL SEQUENCE
  Antibody
EVQLLESGGGLVQPGGSLRLSCAASGFTFSQYKMLWVRQAPGKGLEWVSSIYPSGGWTSYADSVKGRFTISRDNSKNTLYLQMNSLRAEDTAVYYCARASYYDSGGYYRENFQFWGQGTLVTVSS

SEQ ID NO: 467 - DNA, 375 bp, ARTIFICIAL SEQUENCE
  Antibody
gaagttcaattgttagagtctggtggcggtcttgttcagcctggtggttctttacgtctttcttgcgctgcttccggattcactttctctcagtacaagatgctttgggttcgccaagctcctggtaaaggtttggagtgggtttcttctatctatccttctggtggctggacttcttatgctgactccgttaaaggtcgcttcactatctctagagacaactctaagaatactctctacttgcagatgaacagcttaagggctgaggacacggccgtgtattactgtgcgagagcctcttactatgatagtggaggttattaccgagaaaacttccagttttggggccagggcaccctggtcaccgtctcaagc

SEQ ID NO: 468 - protein, 110 aa, ARTIFICIAL SEQUENCE
  Antibody
QDIQMTQSPSSLSASVGDRVTIICRASQSISIYLNWYQQKPGKAPKVLIYDASSLQSGVPSRFSGSGSGTDFSLTITSLQPEDFATYYCQQSYSTPPMYTFGQGTKLEIK

SEQ ID NO: 469 - DNA, 330 bp, ARTIFICIAL SEQUENCE
  Antibody
caagacatccagatgacccagtctccatcctccctgtctgcatctgtaggagacagagtcaccatcatttgccgggcaagtcagagcatcagcatctatttaaattggtatcagcagaaaccagggaaagcccctaaggtcctgatatatgatgcatccagtttgcaaagtggggtcccatcaaggttcagtggcagtggatctgggacagatttcagtctcaccatcaccagtctgcaacctgaagattttgcaacttactactgtcaacagagttacagtacccctcccatgtacacttttggccaggggaccaagctggagatcaaa

SEQ ID NO: 470 - protein, 119 aa, ARTIFICIAL SEQUENCE
  Antibody
EVQLLESGGGLVQPGGSLRLSCAASGFTFSSYKMHWVRQAPGKGLEWVSVIYPSGGATYYADSVKGRFTISRDNSKNTLYLQMNSLRAEDTATYYCAKGLDFWSGPDYWGQGTLVTVSS

SEQ ID NO: 471 - DNA, 357 bp, ARTIFICIAL SEQUENCE
  Antibody
gaagttcaattgttagagtctggtggcggtcttgttcagcctggtggttctttacgtctttcttgcgctgcttccggattcactttctcttcttacaagatgcattgggttcgccaagctcctggtaaaggtttggagtgggtttctgttatctatccttctggtggcgctacttattatgctgactctgttaaaggtcgcttcactatctctagagacaactctaagaatactctctacttgcagatgaacagcttaagggctgaggacacagccacatattactgtgcaaaagggctcgatttttggagtggcccggactactggggccagggcaccctggtcaccgtctcaagc

SEQ ID NO: 472 - protein, 108 aa, ARTIFICIAL SEQUENCE
  Antibody
QDIQMTQSPSSLSASVGDRVTITCWASQDIRTSLAWYQQKPGKPPKLLIFAASTLQGGVPSRFSGSGSGTEFTLTISGLQPEDFATYYCQHLNGYPLTFGDGTKVEIR

SEQ ID NO: 473 - DNA, 324 bp, ARTIFICIAL SEQUENCE
  Antibody
caagacatccagatgacccagtctccatcctccctgtctgcatctgtaggagacagagtcaccatcacttgctgggccagtcaggatattcgcacttctttagcctggtatcagcagaaaccagggaaaccccctaaactcctcatctttgctgcgtctactttgcaaggtggggtcccatcaaggttcagcggcagtggatctgggacagaattcactctcacaatctccggcctgcagcctgaggattttgcgacttattactgtcagcaccttaatggttacccgctcactttcggcgatgggaccaaggtggagatcaga

SEQ ID NO: 474 - protein, 119 aa, ARTIFICIAL SEQUENCE
  Antibody
EVQLLESGGGLVQPGGSLRLSCAASGFTFSNYVMQWVRQAPGKGLEWVSVIYPSGGMTNYADSVKGRFTISRDNSKNTLYLQMNSLRAEDTATYYCARIRGDTRAFDIWGQGTMVTVSS

SEQ ID NO: 475 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctaattacgttatgcagtgggttcgccaagctcctggtaaaggtttggagtgggtttctgttatctatccttctggtggcatgactaattatgctgactccgttaaaggtcgcttcactatctctagagacaactctaagaatactctctacttgcagatgaacagcttaagggctgaggacacagccacgtattactgtgcacggatacgcggtgacaccagggcttttgatatctggggccaagggacaatggtcaccgtctcaagc

SEQ ID NO: 476 - protein, 110 aa, ARTIFICIAL SEQUENCE
  Antibody
QDIQMTQSPGTLSLSPGERATLSCRASQSVSSSYLAWYQQKPGQAPRLLIYGASSRATGIPDRFSGSGSGTDFTLTISRLEPEDLAVYYCQLFGSSPRITFGQGTRLEIK

SEQ ID NO: 477 - DNA, 330 bp, ARTIFICIAL SEQUENCE
  Antibody
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagatttggcagtatattactgtcagctgtttggaagctctcctcggatcaccttcggccaggggacgcggctggaaattaaa

SEQ ID NO: 478 - protein, 125 aa, ARTIFICIAL SEQUENCE
  Antibody
EVQLLESGGGLVQPGGSLRLSCAASGFTFSKYKMWWVRQAPGKGLEWVSVIYPSGGATYYADSVKGRFTISRDNSKNTLYLQMNSLRAEDTAVYYCARSSLGCSSTSCYDAFDIWGQGTMVTVSS

SEQ ID NO: 479 - DNA, 375 bp, ARTIFICIAL SEQUENCE
  Antibody
gaagttcaattgttagagtctggtggcggtcttgttcagcctggtggttctttacgtctttcttgcgctgcttccggattcactttctctaagtacaagatgtggtgggttcgccaagctcctggtaaaggtttggagtgggtttctgttatctatccttctggtggcgctacttattatgctgactccgttaaaggtcgcttcactatctctagagacaactctaagaatactctctacttgcagatgaacagcttaagggctgaggacacggccgtgtattactgtgcgaggtcttctctagggtgtagtagtaccagctgctatgatgcttttgatatctggggccaagggacaatggtcaccgtctcaagc

SEQ ID NO: 480 - protein, 108 aa, ARTIFICIAL SEQUENCE
  Antibody
QDIQMTQSPSSLSASVGDRVTITCRASQGISNYLAWYQQKPGKVPKLLIYAASTLQSGVPSRFSGSGSGTDFTLTISSLQPEDVATYYCQKYNSAPWTFGQGTKVEIK

SEQ ID NO: 481 - DNA, 324 bp, ARTIFICIAL SEQUENCE
  Antibody
caagacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgccccctggacgttcggccaagggaccaaggtggaaatcaaa

SEQ ID NO: 482 - protein, 120 aa, ARTIFICIAL SEQUENCE
  Antibody
EVQLLESGGGLVQPGGSLRLSCAASGFTFSTYGMWWVRQAPGKGLEWVSSISSGGSTVYADSVKGRFTISRDNSKNTLYLQMNSLRAEDTAVYYCARDLTTVTGNYFDYWGQGTLVTVSS

SEQ ID NO: 483 - DNA, 360 bp, ARTIFICIAL SEQUENCE
  Antibody
gaagttcaattgttagagtctggtggcggtcttgttcagcctggtggttctttacgtctttcttgcgctgcttccggattcactttctctacttacggtatgtggtgggttcgccaagctcctggtaaaggtttggagtgggtttcttctatctcttctggtggctctactgtttatgctgactccgttaaaggtcgcttcactatctctagagacaactctaagaatactctctacttgcagatgaacagcttaagggctgaggacacggccgtgtattactgtgcgagagatctgactacggtgacggggaactactttgactactggggccagggaaccctggtcaccgtctcaagc

SEQ ID NO: 484 - protein, 110 aa, ARTIFICIAL SEQUENCE
  Antibody
QDIQMTQSPGTLSLSPGERATLSCRASQSVSSSQLAWYQHKRGQPPRLLIYGASSRATGIPDRFSGSGSGTDYILTISRLEPEDFAVYYCQHFGSSPPATFGQGTKVEIK

SEQ ID NO: 485 - DNA, 330 bp, ARTIFICIAL SEQUENCE
  Antibody
caagacatccagatgacccagtctccaggcaccctatctttgtctccaggggaaagagccaccctctcctgcagggccagtcagagtgtttccagcagccagttagcctggtaccagcataaacgtggccagcctcccaggctcctcatctatggtgcatccagcagggccactggcatcccagacaggttcagtggcagtgggtctgggacagactacattctcaccatcagcagactggagcctgaagattttgcagtgtattactgtcagcattttggtagttcacctccggcgacgttcggccaagggaccaaggtggaaatcaaa

SEQ ID NO: 486 - protein, 125 aa, ARTIFICIAL SEQUENCE
  Antibody
EVQLLESGGGLVQPGGSLRLSCAASGFTFSSYKMVWVRQAPGKGLEWVSSIYPSGGVTIYADSVKGRFTISRDNSKNTLYLQMNSLRAEDTAVYYCARDGSSSGWYNPRRAFDYWGQGTLVTVSS

SEQ ID NO: 487 - DNA, 375 bp, ARTIFICIAL SEQUENCE
  Antibody
gaagttcaattgttagagtctggtggcggtcttgttcagcctggtggttctttacgtctttcttgcgctgcttccggattcactttctcttcttacaagatggtttgggttcgccaagctcctggtaaaggtttggagtgggtttcttctatctatccttctggtggcgttactatttatgctgactccgttaaaggtcgcttcactatctctagagacaactctaagaatactctctacttgcagatgaacagcttaagggctgaggacacggccgtgtattactgtgcgagagatggaagtagcagtggctggtacaatccccgtagggcctttgactactggggccagggaaccctggtcaccgtctcaagc

SEQ ID NO: 488 - protein, 106 aa, ARTIFICIAL SEQUENCE
  Antibody
QYELTQPPSLSVSPGQTVKITCSAEKLSEKYVAWYQQRPGQSPVMVIYQDSRRPSGIPERFSGSNSGNTATLTISGTQPMDEADYYCQAWFSDSLPFGSGTKVTVL

SEQ ID NO: 489 - DNA, 318 bp, ARTIFICIAL SEQUENCE
  Antibody
cagtacgaattgactcagccaccctctctgtccgtgtccccaggacagacagtcaagatcacctgctctgcagagaagttgagtgagaaatatgttgcttggtatcaacagaggccgggccagtcccctgtcatggtcatctatcaagatagtaggcggccctcagggatccctgagcgattctctggctccaactctgggaacacagccactctgaccatcagcgggacccagcccatggatgaggctgactactattgtcaggcgtggtttagcgacagtctcccctttggaagtgggaccaaggtcaccgtccta

SEQ ID NO: 490 - protein, 119 aa, ARTIFICIAL SEQUENCE
  Antibody
EVQLLESGGGLVQPGGSLRLSCAASGFTFSKYKMIWVRQAPGKGLEWVSSIYPSGGHTIYADSVKGRFTISRDNSKNTLYLQMNSLRAEDTAMYYCAREGGGATSFDYWGQGTLVTVSS

SEQ ID NO: 491 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctaagtacaagatgatctgggttcgccaagctcctggtaaaggtttggagtgggtttcttctatctatccttctggtggccatactatttatgctgactccgttaaaggtcgcttcactatctctagagacaactctaagaatactctctacttgcagatgaacagcttaagggctgaggacaccgccatgtattactgtgcgagagagggcgggggagctacctcctttgactactggggccagggaaccctggtcaccgtctcaagc

SEQ ID NO: 492 - protein, 108 aa, ARTIFICIAL SEQUENCE
  Antibody
QDIQMTQSPATLSLSPGERATLSCRASQSVRTYLGWYQQKHGQAPRLLIYDASNRATGIPARFSGSGSGTDFTLTISSLEPEDFAVYYCQQRSNWPLTFGGGTKVEIK

SEQ ID NO: 493 - DNA, 324 bp, ARTIFICIAL SEQUENCE
  Antibody
caagacatccagatgacccagtctccagccaccctgtctttgtctccaggggaaagagccaccctctcctgcagggccagtcagagtgttaggacctatttaggctggtaccaacagaaacatggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgctcactttcggcggagggaccaaggtggagatcaaa

SEQ ID NO: 494 - protein, 119 aa, ARTIFICIAL SEQUENCE
  Antibody
EVQLLESGGGLVQPGGSLRLSCAASGFTFSAYPMFWVRQAPGKGLEWVSVISPSGGQTSYADSVKGRFTISRDNSKNTLYLQMNSLRAEDTAVYYCAKSFSGLAALDFWGQGTLVTVSS

SEQ ID NO: 495 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctgcttaccctatgttttgggttcgccaagctcctggtaaaggtttggagtgggtttctgttatctctccttctggtggccagacttcttatgctgactccgttaaaggtcgcttcactatctctagagacaactctaagaatactctctacttgcagatgaacagcttaagggctgaggacacggccgtgtattactgtgcgaaatcattctcaggcttagcagctcttgacttctggggccagggaaccctggtcaccgtctcaagc

SEQ ID NO: 496 - protein, 110 aa, ARTIFICIAL SEQUENCE
  Antibody
QDIQMTQSPGTLSLSPGERATLSCRASQTVSSGSLAWYQQKPGLAPRLLIYGASRRGTGIPDRFSGSGSGTDFTLTISRLEPEDFAVYYCQQYGSTLPLTFGGGTKVEIK

SEQ ID NO: 497 - DNA, 330 bp, ARTIFICIAL SEQUENCE
  Antibody
caagacatccagatgacccagtctccaggcaccctgtctttgtctccaggggaaagagccaccctctcctgcagggccagtcagacagtgagcagcggctccttagcctggtaccagcagaaacctggcctggctcccaggctcctcatctatggtgcatcccgtaggggcactggcatcccagacaggttcagtggcagtgggtctgggacagacttcactctcaccatcagcagactggagcctgaagattttgcagtgtactactgtcagcagtatggtagtacactcccgctcactttcggcggagggaccaaggtcgagatcaaa

SEQ ID NO: 498 - protein, 119 aa, ARTIFICIAL SEQUENCE
  Antibody
EVQLLESGGGLVQPGGSLRLSCAASGFTFSQYTMYWVRQAPGKGLEWVSSIYPSGGWTNYADSVKGRFTISRDNSKNTLYLQMNSLRAEDMAVYYCARGRGGSKAFDIWGQGTMVTVSS

SEQ ID NO: 499 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctcagtacactatgtattgggttcgccaagctcctggtaaaggtttggagtgggtttcttctatctatccttctggtggctggactaattatgctgactccgttaaaggtcgcttcactatctctagagacaactctaagaatactctctacttgcagatgaacagcttaagggctgaggacatggctgtgtattactgtgcgagaggccgtggtggtagcaaagcttttgatatctggggccaagggacaatggtcaccgtctcaagc

SEQ ID NO: 500 - protein, 110 aa, ARTIFICIAL SEQUENCE
  Antibody
QSELTQPASVSGSPGQSITISCTGTTSDVGGYNYVSWYQQDPGKVPKLIIYEVYNRPSGVSNRFSGSKSGNTASLTISGLRAEDEADYYCSSKTSSVTYVFGTGTKVTVL

SEQ ID NO: 501 - DNA, 330 bp, ARTIFICIAL SEQUENCE
  Antibody
cagagcgaattgactcagcctgcctccgtgtctgggtctcctggacagtcgatcaccatctcctgcactggaaccaccagtgacgttggtggttataactatgtctcctggtatcaacaggacccaggcaaagtccccaaactcataatttatgaggtctataatcggccctcaggggtttcaaatcgcttctctggctccaagtctggcaacacggcctccctgaccatctctgggctccgggctgaggacgaggctgattattactgcagctcaaaaacaagcagcgtcacttatgtctttggaactgggaccaaggtcaccgtccta

SEQ ID NO: 502 - protein, 119 aa, ARTIFICIAL SEQUENCE
  Antibody
EVQLLESGGGLVQPGGSLRLSCAASGFTFSAYVMSWVRQAPGKGLEWVSRIYPSGGGTRYADSVKGRFTISRDNSKNTLYLQMNSLRAEDTAVYYCAKEAGGSYFLDYWGQGTLVTVSS

SEQ ID NO: 503 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctgcttacgttatgtcttgggttcgccaagctcctggtaaaggtttggagtgggtttctcgtatctatccttctggtggcggtactcgttatgctgactccgttaaaggtcgcttcactatctctagagacaactctaagaatactctctacttgcagatgaacagcttaagggctgaggacacggccgtgtattactgtgcgaaagaggcgggtgggagctacttccttgactactggggccagggaaccctggtcaccgtctcaagc

SEQ ID NO: 504 - protein, 109 aa, ARTIFICIAL SEQUENCE
  Antibody
QSELTQPRSVSGSLGQSVTISCTGTTSDVGRYNFVSWYQQYPGRAPKLIIHDVTRRPSGVSDRFSGSKSGNTASLTISGLQAEDEADYYCCSYAGSFYVFGSGTQVTVL

SEQ ID NO: 505 - DNA, 327 bp, ARTIFICIAL SEQUENCE
  Antibody
cagagcgaattgactcagcctcgctcagtgtccgggtctcttggacagtcagtcaccatctcctgcactggaaccaccagtgatgttggtcgttataactttgtctcctggtaccaacagtatccaggcagagcccccaaactcatcattcatgatgtcactcggcggccctccggggtatctgatcgcttctctggctccaagtccggcaacacggcctccctgaccatctctggtctccaggctgaggatgaggctgattattactgctgctcatatgcaggcagcttttatgtcttcggatctgggacccaggtcaccgtcttg

SEQ ID NO: 506 - protein, 119 aa, ARTIFICIAL SEQUENCE
  Antibody
EVQLLESGGGLVQPGGSLRLSCAASGFTFSSYKMIWVRQAPGKGLEWVSGIYPSGGATGYADSVKGRFTISRDNSKNTLYLQMNSLRAEDTATYYCARDGGDIVVPDYWGQGTLVTVSS

SEQ ID NO: 507 - DNA, 357 bp, ARTIFICIAL SEQUENCE
  Antibody
gaagttcaattgttagagtctggtggcggtcttgttcagcctggtggttctttacgtctttcttgcgctgcttccggattcactttctcttcttacaagatgatttgggttcgccaagctcctggtaaaggtttggagtgggtttctggtatctatccttctggtggcgctactggttatgctgactccgttaaaggtcgcttcactatctctagagacaactctaagaatactctctacttgcagatgaacagcttaagggctgaggacacagccacgtattactgtgcgagagatgggggggatattgtagtgcctgactactggggccagggaaccctggtcaccgtctcaagc

SEQ ID NO: 508 - protein, 110 aa, ARTIFICIAL SEQUENCE
  Antibody
QYELTQPPSASGTPGQRVTISCSGSSSNIGTNTVYWYQQLPGTAPKLLIYTNVQRPSGVPDRFSGSKSGTSASLAISGLQSEDEADYYCQSYDGSLSSAVFGGGTQLTVL

SEQ ID NO: 509 - DNA, 330 bp, ARTIFICIAL SEQUENCE
  Antibody
cagtacgaattgactcagccaccctcagcgtctgggacccccgggcagagggtcaccatctcttgttctggaagcagctccaacatcggaactaatactgtatactggtaccagcagctcccaggaacggcccccaaactcctcatctatactaatgtccagcggccctcaggggtccctgaccgattctctggctccaagtctggcacctcagcctccctggccatcagtgggctccagtctgaggatgaggctgattattactgccagtcctatgacggcagcctgagttctgctgtgttcggaggaggcacccagctgaccgtcctc

SEQ ID NO: 510 - protein, 123 aa, ARTIFICIAL SEQUENCE
  Antibody
EVQLLESGGGLVQPGGSLRLSCAASGFTFSKYHMGWVRQAPGKGLEWVSSIYSSGGITQYADSVKGRFTISRDNSKNTLYLQMNSLRAEDTAVYYCARGRVGGWSLFNWFDPWGQGTLVTVSS

SEQ ID NO: 511 - DNA, 369 bp, ARTIFICIAL SEQUENCE
  Antibody
gaagttcaattgttagagtctggtggcggtcttgttcagcctggtggttctttacgtctttcttgcgctgcttccggattcactttctctaagtaccatatgggttgggttcgccaagctcctggtaaaggtttggagtgggtttcttctatctattcttctggtggcattactcagtatgctgactccgttaaaggtcgcttcactatctctagagacaactctaagaatactctctacttgcagatgaacagcttaagggctgaggacacggccgtgtattactgtgcaagaggccgagtcggtggctggtccctttttaactggttcgacccctggggccagggcaccctggtcaccgtctcaagc

SEQ ID NO: 512 - protein, 108 aa, ARTIFICIAL SEQUENCE
  Antibody
QDIQMTQSPGTLSLSPGERATLSCRASQSVSSYLAWYQQKPGQAPRLLIYDASNRATGIPARFSGSGSGTDFTLTISSLEPEDFAVYYCQQRSNWPRTFGQGTKVEIK

SEQ ID NO: 513 - DNA, 324 bp, ARTIFICIAL SEQUENCE
  Antibody
caagacatccagatgacccagtctccaggcaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcggacgttcggccaagggaccaaggtggaaatcaaa

SEQ ID NO: 514 - protein, 118 aa, ARTIFICIAL SEQUENCE
  Antibody
EVQLLESGGGLVQPGGSLRLSCAASGFTFSSYPMYWVRQAPGKGLEWVSRIVPSGGWTNYADSVKGRFTISRDNSKNTLYLQMNSLRAEDTAVYYCARDKGDWYFDLWGRGTLVTVSS

SEQ ID NO: 515 - DNA, 354 bp, ARTIFICIAL SEQUENCE
  Antibody
gaagttcaattgttagagtctggtggcggtcttgttcagcctggtggttctttacgtctttcttgcgctgcttccggattcactttctcttcttaccctatgtattgggttcgccaagctcctggtaaaggtttggagtgggtttctcgtatcgttccttctggtggctggactaactatgctgactccgttaaaggtcgcttcactatctctagagacaactctaagaatactctctacttgcagatgaacagcttaagggctgaggacacggccgtgtattactgtgcgagagataagggggactggtacttcgatctctggggccgtggcaccctggtcaccgtctcaagc

SEQ ID NO: 516 - protein, 110 aa, ARTIFICIAL SEQUENCE
  Antibody
QDIQMTQSPATLSLSPGERATLSCRASQSVSRYLAWYQQKPGQAPRLLIYDTSNRATGIPARFSGSGSGTDFTLTISSLEPEDFAIYYCQQRSNWPPALTFGGGTKVEIK

SEQ ID NO: 517 - DNA, 330 bp, ARTIFICIAL SEQUENCE
  Antibody
caagacatccagatgacccagtctccagccaccctgtctctgtctccaggggagagagccaccctctcctgcagggccagtcagagtgttagcaggtacttagcctggtatcaacaaaaacctggccaggctcccaggctcctcatctatgatacatccaacagggccactggcatcccagccaggttcagtggcagtgggtctgggacagacttcactctcaccatcagcagcctagagcctgaagattttgcaatttattactgtcagcagcgtagcaactggcctccggcgctcactttcggcggagggaccaaggtggagatcaaa

SEQ ID NO: 518 - protein, 120 aa, ARTIFICIAL SEQUENCE
  Antibody
EVQLLESGGGLVQPGGSLRLSCAASGFTFSRYAMGWVRQAPGKGLEWVSWIYPSGGITSYADSVKGRFTISRDNSKNTLYLQMNSLRAEDTAMYYCARITYFDTSVIDYWGQGTLVTVSS

SEQ ID NO: 519 - DNA, 360 bp, ARTIFICIAL SEQUENCE
  Antibody
gaagttcaattgttagagtctggtggcggtcttgttcagcctggtggttctttacgtctttcttgcgctgcttccggattcactttctctcgttacgctatgggttgggttcgccaagctcctggtaaaggtttggagtgggtttcttggatctatccttctggtggcattacttcttatgctgactccgttaaaggtcgcttcactatctctagagacaactctaagaatactctctacttgcagatgaacagcttaagggctgaggacaccgccatgtattactgtgcacggattacgtattttgataccagcgttattgactactggggccagggaaccctggtcaccgtctcaagc

SEQ ID NO: 520 - protein, 110 aa, ARTIFICIAL SEQUENCE
  Antibody
QSVLTQPASVSGSPGQSITISCTGTSSNVGNYNLVSWYQQHPGKAPKLMIYEDNKRPSGVSNRFSVSKSGNTASLTISGLQTEDEAEYYCCSYAGSGTWCFGRRGTRVTV

SEQ ID NO: 521 - DNA, 330 bp, ARTIFICIAL SEQUENCE
  Antibody
cagagcgtcttgactcagcctgcctccgtgtctgggtctcctggacagtcgatcaccatctcctgcactggaaccagcagtaatgttgggaattataaccttgtctcctggtaccagcagcacccaggcaaagcccccaaactcatgatttatgaggacaataagcggccctcaggggtttctaatcgcttctctgtgtccaagtctggcaacacggcctccctgacaatctctgggctccagactgaggacgaggctgaatattactgctgctcatatgcaggtagtggcacttggtgtttcgggcggaggggaaccagagtgaccgtc

SEQ ID NO: 522 - protein, 121 aa, ARTIFICIAL SEQUENCE
  Antibody
EVQLLESGGGLVQPGGSLRLSCAASGFTFSHYPMEWVRQAPGKGLEWVSRIVPSGGWTTYADSVKGRFTISRDNSKNTLYLQMNSLRAEDTAVYYCASRVVTTYLDYFDYWGQGTLVTVSS

SEQ ID NO: 523 - DNA, 363 bp, ARTIFICIAL SEQUENCE
  Antibody
gaagttcaattgttagagtctggtggcggtcttgttcagcctggtggttctttacgtctttcttgcgctgcttccggattcactttctctcattaccctatggagtgggttcgccaagctcctggtaaaggtttggagtgggtttctcgtatcgttccttctggtggctggactacttatgctgactccgttaaaggtcgcttcactatctctagagacaactctaagaatactctctacttgcagatgaacagcttaagggctgaggacacggccgtgtattactgtgcgagtcgggtggtaactacgtacttagactactttgactactggggccagggaaccctggtcaccgtctcaagc

SEQ ID NO: 524 - protein, 119 aa, ARTIFICIAL SEQUENCE
  Antibody
EVQLLESGGGLVQPGGSLRLSCAASGFTFSVYVMSWVRQAPGKGLEWVSSIYPSGGGTYYADSVKGRFTISRDNSKNTLYLQMNSLRAEDTATYYCARRKAAAGYLDYWGQGTLVTVSS

SEQ ID NO: 525 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctgtttacgttatgtcttgggttcgccaagctcctggtaaaggtttggagtgggtttcttctatctatccttctggtggcggtacttattatgctgactccgttaaaggtcgcttcactatctctagagacaactctaagaatactctctacttgcagatgaacagcttaagggctgaggacacagccacatattactgtgcgagacgaaaagcagcagcaggttaccttgactactggggccagggaaccctggtcaccgtctcaagc

SEQ ID NO: 526 - protein, 110 aa, ARTIFICIAL SEQUENCE
  Antibody
QSALTQPASVSGSPGQSITISCTGTSSDIGAYKHVSWYQQHPGKAPKLMIYEVTNRPSGISNRFSGSKSGNTASLTISGLQAEDEADYYCSSYTSRNTWVFGGGTKLTVL

SEQ ID NO: 527 - DNA, 330 bp, ARTIFICIAL SEQUENCE
  Antibody
cagagcgctttgactcagcctgcctccgtgtctgggtctcctggacagtcgatcaccatttcctgcactggaactagcagtgacattggtgcttataaacatgtctcctggtatcaacaacacccaggcaaagcccccaaactcatgatttatgaggtcactaatcggccctcagggatttctaatcgtttctctggctccaagtctggcaacacggcctccctgaccatctctgggctccaggctgaggacgaggctgattattactgcagttcatatacaagccgtaacacttgggtatttggcggagggaccaagctgaccgtccta

SEQ ID NO: 528 - protein, 108 aa, ARTIFICIAL SEQUENCE
  Antibody
QDIQMTQSPGTLSLSPGERATLSCRASQSVSSSYLAWYQQKPGQAPRLLIYDASSRATGIPDRFSGSGSGTDFTLTISRLEPEDFAVYYCQQYGRSPSFGPGTKVDIK

SEQ ID NO: 529 - DNA, 324 bp, ARTIFICIAL SEQUENCE
  Antibody
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatgatgcatccagtagggccactggcatcccagacaggttcagtggcagtgggtctgggacagacttcactctcaccatcagcagactggagcctgaagattttgcagtgtattactgtcagcagtatggtaggtcaccctctttcggccctgggaccaaagtggatatcaaa

SEQ ID NO: 530 - protein, 117 aa, ARTIFICIAL SEQUENCE
  Antibody
EVQLLESGGGLVQPGGSLRLSCAASGFTFSHYKMSWVRQAPGKGLEWVSSIYPSGGWTYYADSVKGRFTISRDNSKNTLYLQMNSLRAEDMAVYYCARDRPGAFDVWGQGTMVTVSS

SEQ ID NO: 531 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctcattacaagatgtcttgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacatggctgtgtattactgtgcaagagatcggcctggagcttttgatgtttggggccaagggacaatggtcaccgtctcaagc

SEQ ID NO: 532 - protein, 109 aa, ARTIFICIAL SEQUENCE
  Antibody
QDIQMTQSPGTLSLSPGERATLSCRASQSVSSSYLAWYQQKPGQAPRLLIYGASSRATGIPDRFSGSGSGTDFTLTISRLEPDDSATYYCQQYNSYPITFGQGTRLEIK

SEQ ID NO: 533 - DNA, 327 bp, ARTIFICIAL SEQUENCE
  Antibody
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgatgattctgcaacctattactgccaacaatataatagttatccgatcaccttcggccaagggacacgactggagattaaa

SEQ ID NO: 534 - protein, 119 aa, ARTIFICIAL SEQUENCE
  Antibody
EVQLLESGGGLVQPGGSLRLSCAASGFTFSSYKMWWVRQAPGKGLEWVSVIYPSGGATYYADSVKGRFTISRDNSKNTLYLQMNSLRAEDTAVYYCARGIGAVGGFDSWGQGTLVTVSS

SEQ ID NO: 535 - DNA, 357 bp, ARTIFICIAL SEQUENCE
  Antibody
gaagttcaattgttagagtctggtggcggtcttgttcagcctggtggttctttacgtctttcttgcgctgcttccggattcactttctcttcttacaagatgtggtgggttcgccaagctcctggtaaaggtttggagtgggtttctgttatctatccttctggtggcgctacttattatgctgactccgttaaaggtcgcttcactatctctagagacaactctaagaatactctctacttgcagatgaacagcttaagggctgaggacacggccgtgtattactgtgcgagagggatcggagcagtgggcgggtttgactcctggggccagggaaccctggtcaccgtctcaagc

SEQ ID NO: 536 - protein, 108 aa, ARTIFICIAL SEQUENCE
  Antibody
QDIQMTQSPSSLSASVGDRVTIACRASHDISDNLNWYQQKPGRAPKVVISDAFNLEAGVPSRFSGSRSGTYFTFTINSLQPEDVATYYCQQFNNVPYTFGQGTKLEIK

SEQ ID NO: 537 - DNA, 324 bp, ARTIFICIAL SEQUENCE
  Antibody
caagacatccagatgacccagtctccatcctccctgtctgcatctgtaggagacagagtcaccatcgcttgccgggcgagtcacgacattagtgacaatttaaattggtatcagcaaaaaccagggagagcccctaaggtcgtgatctccgatgcattcaatttggaagcaggggtcccatcaaggttcagtggaagtagatctgggacatattttactttcaccatcaacagcctgcagcctgaagatgttgcaacatattactgtcaacaatttaataatgtcccgtacacttttggccaggggaccaagctggagatcaaa

SEQ ID NO: 538 - protein, 119 aa, ARTIFICIAL SEQUENCE
  Antibody
EVQLLESGGGLVQPGGSLRLSCAASGFTFSHYIMAWVRQAPGKGLEWVSRIYPSGGKTYYADSVKGRFTISRDNSKNTLYLQMNSLRAEDTAVYYCARQGGGGRAFDIWGQGTMVTVSS

SEQ ID NO: 539 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctcattacattatggcttgggttcgccaagctcctggtaaaggtttggagtgggtttctcgtatctatccttctggtggcaagacttattatgctgactccgttaaaggtcgcttcactatctctagagacaactctaagaatactctctacttgcagatgaacagcttaagggctgaggacacggccgtgtattactgtgcgagacagggtggtggtgggcgtgcttttgatatctggggccaagggacaatggtcaccgtctcaagc

SEQ ID NO: 540 - protein, 108 aa, ARTIFICIAL SEQUENCE
  Antibody
QSALTQDPAVSVALGQTVKITCQGDSLRNYYASWYQQKPGQAPIVVIYGKNNRPSGIPDRFSGSRSGSTASLTITGAQAVDEADYYCSSRDTTNYRMEFGGGTKLTVL

SEQ ID NO: 541 - DNA, 324 bp, ARTIFICIAL SEQUENCE
  Antibody
cagagcgctttgactcaggaccctgctgtgtctgtggccttgggacagacagtcaagatcacatgccaaggagacagtctcagaaattattatgcaagctggtaccagcagaagccaggacaggcccctatagttgtcatctatggtaaaaacaaccggccctcagggatcccagaccgtttctctggctccaggtcaggaagcacagcttccttgaccatcactggggctcaggcggtagatgaggctgactattactgtagttcccgggacactactaattaccgcatggaattcggcggagggaccaagctgactgtccta

SEQ ID NO: 542 - protein, 119 aa, ARTIFICIAL SEQUENCE
  Antibody
EVQLLESGGGLVQPGGSLRLSCAASGFTFSSYIMAWVRQAPGKGLEWVSGIYPSGGFTTYADSVKGRFTISRDNSKNTLYLQMNSLRAEDTAVYYCAKIAGGAYHLDYWGQGTLVTVSS

SEQ ID NO: 543 - DNA, 357 bp, ARTIFICIAL SEQUENCE
  Antibody
gaagttcaattgttagagtctggtggcggtcttgttcagcctggtggttctttacgtctttcttgcgctgcttccggattcactttctcttcttacattatggcttgggttcgccaagctcctggtaaaggtttggagtgggtttctggtatctatccttctggtggctttactacttatgctgactccgttaaaggtcgcttcactatctctagagacaactctaagaatactctctacttgcagatgaacagcttaagggctgaggacacggctgtgtattactgtgcgaaaattgcagggggagcctaccaccttgattactggggccagggaaccctggtcaccgtctcaagc

SEQ ID NO: 544 - protein, 110 aa, ARTIFICIAL SEQUENCE
  Antibody
QDIQMIQSPATLSLSPGERATLSCRASQSVSSYLAWYQQKPGQAPRLLIYDASNRATGIPARFSGSGSGTDFTLTISSLEPEDFAVYYCQQRSNWPPALTFGGGTKVEIK

SEQ ID NO: 545 - DNA, 330 bp, ARTIFICIAL SEQUENCE
  Antibody
caagacatccagatgatccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccggccctcactttcggcggagggaccaaggtggagatcaaa

SEQ ID NO: 546 - protein, 118 aa, ARTIFICIAL SEQUENCE
  Antibody
EVQLLESGGGLVQPGGSLRLSCAASGFTFSRYGMEWVRQAPGKGLEWVSSIYPSGGWTYYADSVKGRFTISRDNSKNTLYLQMNSLRAEDTAVYYCARRGSGRYFDYWGQGTLVTVSS

SEQ ID NO: 547 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctcgttacggtatggagtgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacacggccgtgtattactgtgcgagacggggtagtggccggtactttgactactggggccagggcaccctggtcaccgtctcaagc

SEQ ID NO: 548 - protein, 110 aa, ARTIFICIAL SEQUENCE
  Antibody
QSELTQPPSASGSPGQSVTITCTGTSSDVGYYNYVSWYQQHPGKAPKLMIFEVSNRPSGVPDRFSGSKSGNTASLTVSGLQAEDEAHYYCSSYAGSDNFVFGSGTKVTVL

SEQ ID NO: 549 - DNA, 330 bp, ARTIFICIAL SEQUENCE
  Antibody
cagagcgaattgactcagcctccctccgcgtccgggtctcctggacagtcagtcaccatcacctgcactggaaccagcagtgacgttggttattataactatgtctcctggtatcaacaacacccaggcaaagcccccaaactcatgatttttgaggtcagtaatcggccctcaggggtccctgatcgcttctctggctccaagtctggcaacacggcctccctgaccgtctctgggctccaggctgaggatgaggctcattattactgcagctcatatgcaggcagcgacaattttgtcttcggaagtgggaccaaggtcaccgtctta

SEQ ID NO: 550 - protein, 119 aa, ARTIFICIAL SEQUENCE
  Antibody
EVQLLESGGGLVQPGGSLRLSCAASGFTFSIYVMGWVRQAPGKGLEWVSSIYPSGGYTWYADSVKGRFTISRDNSKNTLYLQMNSLRAEDTAVYYCARQGGGGRAFDIWGQGTTVTVSS

SEQ ID NO: 551 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctatttacgttatgggttgggttcgccaagctcctggtaaaggtttggagtgggtttcttctatctatccttctggtggctatacttggtatgctgactccgttaaaggtcgcttcactatctctagagacaactctaagaatactctctacttgcagatgaacagcttaagggctgaggacacggccgtgtattactgtgcgagacagggaggaggcggtcgtgcttttgatatctggggccaagggaccacggtcaccgtctcaagc

SEQ ID NO: 552 - protein, 112 aa, ARTIFICIAL SEQUENCE
  Antibody
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLFYVFGTGTKVTVL

SEQ ID NO: 553 - DNA, 336 bp, ARTIFICIAL SEQUENCE
  Antibody
cagagcgtcttgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcttttatgtcttcggaactgggaccaaggtcaccgtccta

SEQ ID NO: 554 - protein, 129 aa, ARTIFICIAL SEQUENCE
  Antibody
EVQLLESGGGLVQPGGSLRLSCAASGFTFSRYKMMWVRQAPGKGLEWVSYIVPSGGWTYYADSVKGRFTISRDNSKNTLYLQMNSLRAEDTAVYYCARVDYYDFWSGYWWSGGYGMDVWGQGTTVTVSS

SEQ ID NO: 555 - DNA, 387 bp, ARTIFICIAL SEQUENCE
  Antibody
gaagttcaattgttagagtctggtggcggtcttgttcagcctggtggttctttacgtctttcttgcgctgcttccggattcactttctctcgttacaagatgatgtgggttcgccaagctcctggtaaaggtttggagtgggtttcttatatcgttccttctggtggctggacttattatgctgactccgttaaaggtcgcttcactatctctagagacaactctaagaatactctctacttgcagatgaacagcttaagggctgaggacacggccgtgtattactgtgcgagagttgactattacgatttttggagtggttattggtggtcgggggggtacggtatggacgtctggggccaagggaccacggtcaccgtctcaagc

SEQ ID NO: 556 - protein, 108 aa, ARTIFICIAL SEQUENCE
  Antibody
QDIQMTQSPSFLSASVGDRVTITCRASQGISTYLAWYQQKPGKAPKLLIYATSTLQSGVPSRFSGSGSGTEFTLAISTLQPEDFATYYCQQLNSYPITFGQGTRLEIK

SEQ ID NO: 557 - DNA, 324 bp, ARTIFICIAL SEQUENCE
  Antibody
caagacatccagatgacccagtctccatccttcctgtctgcatctgtaggagacagagtcaccatcacttgccgggccagtcagggcataagcacttatttagcctggtatcagcaaaagccagggaaagcccctaagctcttgatctatgctacatccactttgcaaagtggagtcccatcaaggttcagcggcagtgggtctgggacagaattcactctcgcaatcagcaccctgcagcctgaagattttgcaacttattactgtcaacaactcaatagttacccgatcactttcggccaagggacgcgactggagattaaa

SEQ ID NO: 558 - protein, 117 aa, ARTIFICIAL SEQUENCE; identical to SEQ ID NO: 390
  Antibody

SEQ ID NO: 559 - DNA, 351 bp, ARTIFICIAL SEQUENCE; identical to SEQ ID NO: 391
  Antibody

SEQ ID NO: 560 - protein, 108 aa, ARTIFICIAL SEQUENCE
  Antibody
QNIQMTQSPATLSLSPGERATLSCRASQSISSYLAWYQQKPGQVPRLLIYDASNRATGIPARFSGSGSGTDFTLTISRLEPEDFAVYYCQQYGSLPRTFGQGTKVEIK

SEQ ID NO: 561 - DNA, 324 bp, ARTIFICIAL SEQUENCE
  Antibody
caaaacatccagatgacccagtctccagccaccctgtctttgtctccaggggagagagccaccctctcctgcagggccagtcagagtattagcagttacttagcctggtatcaacagaaacctggccaggttcccaggctcctcatctatgatgcatccaatagggccactggcatcccagccaggttcagtggcagtgggtctgggacagacttcactctcaccatcagcagactggagcctgaagattttgcagtttattactgtcagcagtatggtagtttacctcggacgttcggccaagggaccaaggtggaaatcaaa

SEQ ID NO: 562 - protein, 119 aa, ARTIFICIAL SEQUENCE
  Antibody
EVQLLESGGGLVQPGGSLRLSCAASGFTFSKYKMHWVRQAPGKGLEWVSVIYPSGGKTYYADSVKGRFTISRDNSKNTLYLQMNSLRAEDTAVYYCAREMGGSGWYDYWGQGTLVTVSS

SEQ ID NO: 563 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctaagtacaagatgcattgggttcgccaagctcctggtaaaggtttggagtgggtttctgttatctatccatctggtggcaagacttattatgctgactccgttaaaggtcgcttcactatctctagagacaactctaagaatactctctacttgcagatgaacagcttaagggctgaggacacggccgtgtattactgtgcgagagaaatgggtggtagtggctggtacgactactggggccagggaaccctggtcaccgtctcaagc

SEQ ID NO: 564 - protein, 108 aa, ARTIFICIAL SEQUENCE
  Antibody
QDIQMTQSPATLSLSPGARATLSCRASQSVSSYLAWYQQRPGQTPRLLIYGASSRATGIPDRFSGSGSGTDFTLTISRLEPEDFAVYYCQQYGSSRHTFGQGTKLEIK

SEQ ID NO: 565 - DNA, 324 bp, ARTIFICIAL SEQUENCE
  Antibody
caagacatccagatgacccagtctccagccaccctgtctttgtctccaggggcaagagccaccctctcctgcagggccagtcagagtgttagcagctacttagcctggtaccaacagagacctggccagactcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacgacacacttttggccaggggaccaagctggagatcaaa

SEQ ID NO: 566 - protein, 119 aa, ARTIFICIAL SEQUENCE
  Antibody
EVQLLESGGGLVQPGGSLRLSCAASGFTFSQYVMRWVRQAPGKGLEWVSGIYPSGGWTTYADSVKGRFTISRDNSKNTLYLQMNSLRAEDTAVYYCATVAAAAGAFDIWGQGTMVTVSS

SEQ ID NO: 567 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctcagtacgttatgcgttgggttcgccaagctcctggtaaaggtttggagtgggtttctggtatctatccttctggtggctggactacttatgctgactccgttaaaggtcgcttcactatctctagagacaactctaagaatactctctacttgcagatgaacagcttaagggctgaggacacggccgtgtattactgtgcaacagtggcagcagctgcgggggcttttgatatctggggccaagggacaatggtcaccgtctcaagc

SEQ ID NO: 568 - protein, 109 aa, ARTIFICIAL SEQUENCE
  Antibody
QDIQMTQSPGTLSLSPGERATLSCRASQSISSSYLAWYQQKPGQAPRLLLYGTSNRATGIPDRFSGSGSGTDFTLTISRLEPEDFALYYCQQRYKWPLTFGPGTKVDFK

SEQ ID NO: 569 - DNA, 327 bp, ARTIFICIAL SEQUENCE
  Antibody
caagacatccagatgacccagtctccaggcaccctgtctttgtctccaggggaaagagccaccctctcctgcagggccagtcagagtattagcagcagctacttagcctggtaccagcagaaacctggccaggctccccggctcctcctctatggtacatccaacagggccactggcatcccagacaggttcagtggcagtgggtctgggacagacttcactctcaccatcagcagactggagcctgaagactttgcactttattactgtcagcagcgttacaagtggcctctcactttcggccctgggaccaaggtggatttcaaa

SEQ ID NO: 570 - protein, 119 aa, ARTIFICIAL SEQUENCE
  Antibody
EVQLLESGGGLVQPGGSLRLSCAASGFTFSHYGMWWVRQAPGKGLEWVSVISPSGGQTNYADSVKGRFTISRDNSKNTLYLQMNSLRAEDTAVYYCAKGQIHGGNLASWGQGTLVTVSS

SEQ ID NO: 571 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctcattacggtatgtggtgggttcgccaagctcctggtaaaggtttggagtgggtttctgttatctctccttctggtggccagactaattatgctgactccgttaaaggtcgcttcactatctctagagacaactctaagaatactctctacttgcagatgaacagcttaagggctgaggacactgccgtgtattactgtgccaaagggcaaatccacggtggtaatcttgcctcctggggccagggaaccctggtcaccgtctcaagc

SEQ ID NO: 572 - protein, 111 aa, ARTIFICIAL SEQUENCE
  Antibody
QSALTQPASVSGSPGQSITISCTGTSSDVGGYNYVSWYQQHPGKAPKLMISDVSNRPSGVSNRFSGSKSGNTASLTISGLQAEDEADYYCSSYTSSSTLYVFGTGTKVTVL

SEQ ID NO: 573 - DNA, 333 bp, ARTIFICIAL SEQUENCE
  Antibody
cagagcgctttgactcagcctgcctccgtgtctgggtctcctggacagtcgatcaccatctcctgcactggaactagcagcgacgttggtggttataactatgtctcctggtaccaacagcacccaggcaaagcccccaaactcatgatttctgatgtcagtaatcggccctcaggggtttctaatcgcttctctggctccaagtctggcaacacggcctccctgaccatctctgggctccaggctgaggacgaggctgattattactgcagctcatatacaagcagcagcactctgtatgtcttcggaactgggaccaaggtcaccgtccta

SEQ ID NO: 574 - protein, 122 aa, ARTIFICIAL SEQUENCE
  Antibody
EVQLLESGGGLVQPGGSLRLSCAASGFTFSNYKMNWVRQAPGKGLEWVSVIYPSGGATYYADSVKGRFTISRDNSKNTLYLQMNSLRAEDTAMYYCARVGYSSSWDPHFDYWGQGTLVTVSS

SEQ ID NO: 575 - DNA, 366 bp, ARTIFICIAL SEQUENCE
  Antibody
gaagttcaattgttagagtctggtggcggtcttgttcagcctggtggttctttacgtctttcttgcgctgcttccggattcactttctctaattacaagatgaattgggttcgccaagctcctggtaaaggtttggagtgggtttctgttatctatccttctggtggcgctacttattatgctgactccgttaaaggtcgcttcactatctctagagacaactctaagaatactctctacttgcagatgaacagcttaagggctgaggacaccgccatgtattactgtgcgagagtcgggtatagcagcagctgggacccccactttgactactggggccagggaaccctggtcaccgtctcaagc

SEQ ID NO: 576 - protein, 109 aa, ARTIFICIAL SEQUENCE
  Antibody
QDIQMTQSPATLSLSPGERATLSCRASQSVSSSYLAWYQQKPGQAPRLLIYGASSRATGIPDRFSGSGSGTEFTLTISSLQSEDFGVYYCQQYKDWPRTFGQGTKVEIK

SEQ ID NO: 577 - DNA, 327 bp, ARTIFICIAL SEQUENCE
  Antibody
caagacatccagatgacccagtctccagccaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagagttcactctcaccatcagcagcctgcagtctgaagattttggagtttattattgtcagcagtataaggactggcctcgaacgttcggccaagggaccaaggtggaaatcaaa

SEQ ID NO: 578 - protein, 128 aa, ARTIFICIAL SEQUENCE
  Antibody
EVQLLESGGGLVQPGGSLRLSCAASGFTFSSYRMVWVRQAPGKGLEWVSSIYPSGGPTRYADSVKGRFTISRDNSKNTLYLQMNSLRAEDTAVYYCARWSYYYDSSGYYPVSGPFDIWGQGTMVTVSS

SEQ ID NO: 579 - DNA, 384 bp, ARTIFICIAL SEQUENCE
  Antibody
gaagttcaattgttagagtctggtggcggtcttgttcagcctggtggttctttacgtctttcttgcgctgcttccggattcactttctcttcttaccgtatggtttgggttcgccaagctcctggtaaaggtttggagtgggtttcttctatctatccttctggtggccctactcgttatgctgactccgttaaaggtcgcttcactatctctagagacaactctaagaatactctctacttgcagatgaacagcttaagggctgaggacacggccgtgtattactgtgcgagatggtcgtattactatgatagtagtggttattaccccgtgagtgggccttttgatatctggggccaagggacaatggtcaccgtctcaagc

SEQ ID NO: 580 - protein, 110 aa, ARTIFICIAL SEQUENCE
  Antibody
QDIQMTQSPGTLSLSPGERATLSCRASQGVRSTYLAWYQQKPGQAPRLLIYGASSRATGIPDRFSGSGSGTDFTLTISRLEPEDFAVYYCQQYGSSQGFTFGPGTKVDIK

SEQ ID NO: 581 - DNA, 330 bp, ARTIFICIAL SEQUENCE
  Antibody
caagacatccagatgacccagtctccaggcaccctgtctttgtctccaggggaaagagccaccctctcctgcagggccagtcagggtgttagaagtacctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacagggtttcactttcggccctgggaccaaagtggatatcaaa

SEQ ID NO: 582 - protein, 117 aa, ARTIFICIAL SEQUENCE
  Antibody
EVQLLESGGGLVQPGGSLRLSCAASGFTFSMYKMHWVRQAPGKGLEWVSVIYPSGGITAYADSVKGRFTISRDNSKNTLYLQMNSLRADDTAVYYCTREVMGPSDYWGQGTLVTVSS

SEQ ID NO: 583 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctatgtacaagatgcattgggttcgccaagctcctggtaaaggtttggagtgggtttctgttatctatccttctggtggcattactgcttatgctgactccgttaaaggtcgcttcactatctctagagacaactctaagaatactctctacttgcagatgaacagcttaagggctgatgacacagccgtgtattactgtactagagaggttatgggaccatctgactactggggccagggaaccctggtcaccgtctcaagc

SEQ ID NO: 584 - protein, 108 aa, ARTIFICIAL SEQUENCE
  Antibody
QDIQMTQSPATLSVSPGERATLSCRSSQSLSNNLAWYQQKPGQAPRLLIYGASTRATGIPARFSGSGSGTEFTLTISSLQSEDFATYYCQQANSFPRTFGQGTKLEIK

SEQ ID NO: 585 - DNA, 324 bp, ARTIFICIAL SEQUENCE
  Antibody
caagacatccagatgacccagtctccagccaccctgtctgtgtctccaggggaaagagccaccctctcctgcaggtccagtcagagtcttagcaacaacttagcctggtaccagcagaaacctggccaggctcccaggctcctcatctatggtgcatccaccagggccactggcatcccagccaggttcagtggcagtgggtctgggacagagttcactctcaccatcagcagcctgcagtctgaagattttgcaacttactattgtcaacaggctaacagtttccctcgaacttttggccaggggaccaagctggagatcaaa

SEQ ID NO: 586 - protein, 120 aa, ARTIFICIAL SEQUENCE
  Antibody
EVQLLESGGGLVQPGGSLRLSCAASGFTFSKYVMHWVRQAPGKGLEWVSSIYPSGGWTYYADSVKGRFTISRDNSKNTLYLQMNSLRAEDTAVYYCATSTTYSSRPFDYWGQGTLVTVSS

SEQ ID NO: 587 - DNA, 360 bp, ARTIFICIAL SEQUENCE
  Antibody
gaagttcaattgttagagtctggtggcggtcttgttcagcctggtggttctttacgtctttcttgcgctgcttccggattcactttctctaagtacgttatgcattgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacacggccgtgtattactgtgcgacctctacgacttatagcagcaggccctttgactattggggccagggaaccctggtcaccgtctcaagc

SEQ ID NO: 588 - protein, 109 aa, ARTIFICIAL SEQUENCE
  Antibody
QDIQMTQSPSSLSASVGDRVAITCRASQSIDTYLNWYQHKPGKAPKLLIYAASKLEDGVPSRFSGSGTGTDFTLTIRSLQPEDFASYFCQQSYSSPGITFGPGTKVEIK

SEQ ID NO: 589 - DNA, 327 bp, ARTIFICIAL SEQUENCE
  Antibody
caagacatccagatgacccagtctccatcctccctgtctgcatctgtgggagacagagtcgccatcacttgccgcgcaagtcagagcatcgacacctatttaaattggtatcagcacaaaccagggaaagcccctaaactcctgatctatgctgcatccaagttggaagacggggtcccatcaagattcagtggcagtggaactgggacagatttcactctcaccatcagaagtctgcaacctgaagattttgcaagttatttctgtcaacagagctactctagtccagggatcactttcggccctgggaccaaggtggagatcaaa

SEQ ID NO: 590 - protein, 120 aa, ARTIFICIAL SEQUENCE
  Antibody
EVQLLESGGGLVQPGGSLRLSCAASGFTFSRYPMMWVRQAPGKGLEWVSVIYSSGGYTYYADSVKGRFTISRDNSKNTLYLQMNSLRAEDTAVYYCARVSRGIYYAMDVWGQGTTVTVSS

SEQ ID NO: 591 - DNA, 360 bp, ARTIFICIAL SEQUENCE
  Antibody
gaagttcaattgttagagtctggtggcggtcttgttcagcctggtggttctttacgtctttcttgcgctgcttccggattcactttctctcgttaccctatgatgtgggttcgccaagctcctggtaaaggtttggagtgggtttctgttatctattcttctggtggctatacttattatgctgactccgttaaaggtcgcttcactatctctagagacaactctaagaatactctctacttgcagatgaacagcttaagggctgaggacacggccgtgtattactgtgcgagagtatctcgcgggatctactacgctatggacgtctggggccaagggaccacggtcaccgtctcaagc

SEQ ID NO: 592 - protein, 109 aa, ARTIFICIAL SEQUENCE
  Antibody
QDIQMTQSPGTLSLSPGERATLSCRASQSVSSSYLAWYQQKPGQAPRLLIYGASSRATGIPDRFSGSGSGTDFTLTISRLEPEDFVVYYCQQYGRSRYTFGQGTKLEIK

SEQ ID NO: 593 - DNA, 327 bp, ARTIFICIAL SEQUENCE
  Antibody
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgtagtgtattactgtcagcagtatggtaggtcacggtacacttttggccaggggaccaagctggagatcaaa

SEQ ID NO: 594 - protein, 124 aa, ARTIFICIAL SEQUENCE
  Antibody
EVQLLESGGGLVQPGGSLRLSCAASGFTFSNYKMHWVRQAPGKGLEWVSSIYPSGGPTHYADSVKGRFTISRDNSKNTLYLQMNSLRAEDTAVYYCAREGYSSGWYIHWYFDLWGRGTLVTVSS

SEQ ID NO: 595 - DNA, 372 bp, ARTIFICIAL SEQUENCE
  Antibody
gaagttcaattgttagagtctggtggcggtcttgttcagcctggtggttctttacgtctttcttgcgctgcttccggattcactttctctaattacaagatgcattgggttcgccaagctcctggtaaaggtttggagtgggtttcttctatctatccttctggtggccctactcattatgctgactccgttaaaggtcgcttcactatctctagagacaactctaagaatactctctacttgcagatgaacagcttaagggctgaggacacggccgtgtattactgtgcgagagaagggtatagcagtggctggtacattcactggtacttcgatctctggggccgtggcaccctggtcaccgtctcaagc

SEQ ID NO: 596 - protein, 108 aa, ARTIFICIAL SEQUENCE
  Antibody
QDIQMTQSPSSLSASVGDRVAITCRASQSIDTYLNWYQQKPGKAPKLLIYDASNLETGVPSRFSGSGSGTHFTFTISSLQPEDFATYYCQQADSFPITFGQGTRLEIK

SEQ ID NO: 597 - DNA, 324 bp, ARTIFICIAL SEQUENCE
  Antibody
caagacatccagatgacccagtctccatcctccctgtctgcatctgtgggagacagagtcgccatcacttgccgcgcaagtcagagcatcgacacctatttaaattggtatcagcagaaaccagggaaagcccctaagctcctgatctacgatgcatccaatttggaaacaggggtcccatcaaggttcagtggaagtggatctgggacacactttaccttcaccatcagcagcctgcagcctgaagattttgcaacttactattgtcagcaggctgacagtttcccgatcaccttcggccaagggacacgactggagattaaa

SEQ ID NO: 598 - protein, 120 aa, ARTIFICIAL SEQUENCE
  Antibody
EVQLLESGGGLVQPGGSLRLSCAASGFTFSSYFMTWVRQAPGKGLEWVSGISPSGGITSYADSVKGRFTISRDNSKNTLYLQMNSLRAEDTAVYYCAKGSYSDYGVFNSWGQGTLVTVSS

SEQ ID NO: 599 - DNA, 360 bp, ARTIFICIAL SEQUENCE
  Antibody
gaagttcaattgttagagtctggtggcggtcttgttcagcctggtggttctttacgtctttcttgcgctgcttccggattcactttctcttcttactttatgacttgggttcgccaagctcctggtaaaggtttggagtgggtttctggtatctctccttctggtggcattacttcttatgctgactccgttaaaggtcgcttcactatctctagagacaactctaagaatactctctacttgcagatgaacagcttaagggctgaggacacggccgtgtattactgtgcgaaaggctcatacagtgattacggggtctttaattcctggggccagggaaccctggtcaccgtctcaagc

SEQ ID NO: 600 - protein, 108 aa, ARTIFICIAL SEQUENCE
  Antibody
QDIQMTQSPATLSVSPGERATLSCRASQSISSSLAWYQQKPGQAPRLLIYDASNRATGIPARFSGSGSGTDFTLTISSLEPEDFAVYYCQQRSNWPLTFGGGTKVEIK

SEQ ID NO: 601 - DNA, 324 bp, ARTIFICIAL SEQUENCE
  Antibody
caagacatccagatgacccagtctccagccaccctgtctgtgtctccaggggaaagagccaccctctcctgcagggccagtcagagtattagcagcagcttagcctggtaccagcagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgctcactttcggcggagggaccaaggtggagatcaaa

SEQ ID NO: 602 - protein, 117 aa, ARTIFICIAL SEQUENCE
  Antibody
EVQLLESGGGLVQPGGSLRLSCAASGFTFSNYVMAWVRQAPGKGLEWVSVIYPSGGATYYADSVKGRFTISRDNSKNTLYLQMNSLRAEDTAVYYCTRLAVTHFDYWGQGTLVTVSS

SEQ ID NO: 603 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctaattacgttatggcttgggttcgccaagctcctggtaaaggtttggagtgggtttctgttatctatccttctggtggcgctacttattatgctgactccgttaaaggtcgcttcactatctctagagacaactctaagaatactctctacttgcagatgaacagcttaagggctgaggacacggccgtgtattactgtacgagactggcggttactcactttgactactggggccagggaaccctggtcaccgtctcaagc

SEQ ID NO: 604 - protein, 108 aa, ARTIFICIAL SEQUENCE
  Antibody
QDIQMTQSPSTLSASVGDRVTITCRASQGISNYLAWYQQKPGKVPKLLIYGASNLQSGVSSRFSGSGSATDFTLTISSLQPEDFATYYCQQFNSYPLTFGGGTKVEIK

SEQ ID NO: 605 - DNA, 324 bp, ARTIFICIAL SEQUENCE
  Antibody
caagacatccagatgacccagtctccttccaccctgtctgcatctgtaggagacagagtcaccatcacttgccgggcgagtcagggcattagcaattatttagcctggtatcaacagaaaccagggaaagttcctaaactcctgatctatggtgcatctaatttgcagtcaggggtctcatcgcggttcagtggcagtggatctgcgacagatttcaccctcaccatcagcagcctgcagcctgaagattttgcaacttattactgtcaacagtttaatagttaccctctgactttcggcggagggaccaaggtggagatcaaa

SEQ ID NO: 606 - protein, 118 aa, ARTIFICIAL SEQUENCE
  Antibody
EVQLLESGGGLVQPGGSLRLSCAASGFTFSDYGMAWVRQAPGKGLEWVSVISPSGGQTAYADSVKGRFTISRDNSKNTLYLQMNSLRAEDTAVYYCATVRWFGAFDYWGQGTLVTVSS

SEQ ID NO: 607 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctgattacggtatggcttgggttcgccaagctcctggtaaaggtttggagtgggtttctgttatctctccttctggtggccagactgcttatgctgactccgttaaaggtcgcttcactatctctagagacaactctaagaatactctctacttgcagatgaacagcttaagggctgaggacacggctgtgtattactgtgccacagttagatggttcggggcatttgactactggggccagggaaccctggtcaccgtctcaagc

SEQ ID NO: 608 - protein, 111 aa, ARTIFICIAL SEQUENCE
  Antibody
QDIQMTQSPGTLSLSPGERATLSCRASQSVTSSFLSWYQHRPGQAPRLLIYATSTRATGIPDRFSGSGSGTDFTLTISRLEPEDFAVYYCQHYHTSPPTYTFGQGTKLEIK

SEQ ID NO: 609 - DNA, 333 bp, ARTIFICIAL SEQUENCE
  Antibody
caagacatccagatgacccagtctccaggcacgctgtctttgtctccaggggaaagagccaccctctcctgcagggccagtcaaagtgtgaccagcagcttcttatcctggtaccagcacagacctggccaggctcccaggctcctcatctatgctacatccaccagggccacaggcatcccagacaggttcagtggcagtgggtctgggacagacttcactctcactatcagcagactggagcctgaagattttgcagtgtattactgtcagcactatcatacctcacctcccacttacacttttggccaggggaccaagctggagatcaaa

SEQ ID NO: 610 - protein, 117 aa, ARTIFICIAL SEQUENCE
  Antibody
EVQLLESGGGLVQPGGSLRLSCAASGFTFSLYLMYWVRQAPGKGLEWVSVIYPSGGWTYYADSVKGRFTISRDNSKNTLYLQMNSLRAEDTAMYYCARGYYYGMDVWGQGTTVTVSS

SEQ ID NO: 611 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctctttaccttatgtattgggttcgccaagctcctggtaaaggtttggagtgggtttctgttatctatccttctggtggctggacttattatgctgactccgttaaaggtcgcttcactatctctagagacaactctaagaatactctctacttgcagatgaacagcttaagggctgaggacaccgccatgtattactgtgcgagaggctactactacggtatggacgtctggggccaagggaccacggtcaccgtctcaagc

SEQ ID NO: 612 - protein, 110 aa, ARTIFICIAL SEQUENCE
  Antibody
QSALTQPPSVSVAPGETAEITCGGENIGSKSVHWYQQKPGQAPVLVIYYDNDRPSGIPERFSGSNFGSTATLTISRVEAGDEADYYCQVWDSGSEHYVFGTETKVTVLGQ

SEQ ID NO: 613 - DNA, 330 bp, ARTIFICIAL SEQUENCE
  Antibody
cagagcgctttgactcagccaccctcagtctcagtggccccaggggagacggccgaaattacctgtgggggcgagaacattggaagtaaaagtgtccattggtaccagcagaagccaggccaggccccagtgctggtcatctattatgataacgaccgcccctcagggatccctgagcgattctctggctccaactttgggagcacggccaccctgaccatcagcagggtcgaagccggggatgaggccgactattactgtcaggtctgggatagtggcagtgagcactatgtcttcggaactgagaccaaggtcaccgtcctaggtcag

SEQ ID NO: 614 - protein, 116 aa, ARTIFICIAL SEQUENCE
  Antibody
EVQLLESGGGLVQPGGSLRLSCAASGFTFSGYIMMWVRQAPGKGLEWVSSIYPSGGHTYYADSVKGRFTISRDNSKNTLYLQMNSLRAEDTAVYYCARWYYGMDVWGQGTTVTVSS

SEQ ID NO: 615 - DNA, 348 bp, ARTIFICIAL SEQUENCE
  Antibody
gaagttcaattgttagagtctggtggcggtcttgttcagcctggtggttctttacgtctttcttgcgctgcttccggattcactttctctggttacattatgatgtgggttcgccaagctcctggtaaaggtttggagtgggtttcttctatctatccttctggtggccatacttattatgctgactccgttaaaggtcgcttcactatctctagagacaactctaagaatactctctacttgcagatgaacagcttaagggctgaggacacggccgtgtattactgtgcgagatggtattacggtatggacgtctggggccaagggaccacggtcaccgtctcaagc

SEQ ID NO: 616 - protein, 109 aa, ARTIFICIAL SEQUENCE
  Antibody
QSALTQPASVSGSPGQSITISCTGTNSDVGGYNYVSWYQQHPGKAPKLIIFDVTNRPSGVSNRFSGSKAGNTASLTISGLQAEDEADYYCSSYSSTSPRFGGGTKLTVL

SEQ ID NO: 617 - DNA, 327 bp, ARTIFICIAL SEQUENCE
  Antibody
cagagcgctttgactcagcctgcctccgtgtcagggtctcctggacagtcgatcaccatttcctgcactggaaccaacagtgacgttggtggttataactatgtctcctggtaccaacagcacccaggcaaagcccccaaactcataatttttgatgtcactaatcggccctcaggggtttctaatcgcttctctggctccaaggctggcaacacggcctccctgaccatctctgggctccaggctgaggacgaggctgattattactgcagctcatattcaagtaccagccctcgcttcggcggagggaccaagctgaccgtcctg

SEQ ID NO: 618 - protein, 120 aa, ARTIFICIAL SEQUENCE
  Antibody
EVQLLESGGGLVQPGGSLRLSCAASGFTFSMYQMQWVRQAPGKGLEWVSRIYPSGGWTVYADSVKGRFTISRDNSKNTLYLQMNSLRAEDTAVYYCTRITYDSSGYYDYWGQGTLVTVSS

SEQ ID NO: 619 - DNA, 360 bp, ARTIFICIAL SEQUENCE
  Antibody
gaagttcaattgttagagtctggtggcggtcttgttcagcctggtggttctttacgtctttcttgcgctgcttccggattcactttctctatgtaccagatgcagtgggttcgccaagctcctggtaaaggtttggagtgggtttctcgtatctatccttctggtggctggactgtttatgctgactccgttaaaggtcgcttcactatctctagagacaactctaagaatactctctacttgcagatgaacagcttaagggctgaggacacagccgtgtattactgtacacggatcacgtatgatagtagtggttattacgactactggggccagggaaccctggtcaccgtctcaagc

SEQ ID NO: 620 - protein, 109 aa, ARTIFICIAL SEQUENCE; identical to SEQ ID NO: 588
  Antibody

SEQ ID NO: 621 - DNA, 327 bp, ARTIFICIAL SEQUENCE; identical to SEQ ID NO: 589
  Antibody

SEQ ID NO: 622 - protein, 121 aa, ARTIFICIAL SEQUENCE
  Antibody
EVQLLESGGGLVQPGGSLRLSCAASGFTFSPYKMIWVRQAPGKGLEWVSGIYPSGGWTYYADSVKGRFTISRDNSKNTLYLQMNSLRAEDTAMYYCARLLPALRGAVMDVWGQGTTVTVSS

SEQ ID NO: 623 - DNA, 363 bp, ARTIFICIAL SEQUENCE
  Antibody
gaagttcaattgttagagtctggtggcggtcttgttcagcctggtggttctttacgtctttcttgcgctgcttccggattcactttctctccttacaagatgatttgggttcgccaagctcctggtaaaggtttggagtgggtttctggtatctatccttctggtggctggacttattatgctgactccgttaaaggtcgcttcactatctctagagacaactctaagaatactctctacttgcagatgaacagcttaagggctgaggacaccgccatgtattactgtgcgagactgttaccagccttgcggggagccgtgatggacgtctggggccaagggaccacggtcaccgtctcaagc

SEQ ID NO: 624 - protein, 107 aa, ARTIFICIAL SEQUENCE
  Antibody
QSVLTQDPTVSVALGQTVRITCRGDRLRSYYSSWYQQKPRQAPVLVMFGRNNRPSGIPDRFSGSTSGSTASLTITATQADDEADYFCSSRDGSGNFLFGGGTKLTVL

SEQ ID NO: 625 - DNA, 321 bp, ARTIFICIAL SEQUENCE
  Antibody
cagagcgtcttgactcaggaccctactgtgtctgtggccttggggcagacagtcaggatcacatgccgaggagacagactcagaagttattattcaagttggtaccagcagaagccacgacaggcccctgttcttgtcatgtttggtagaaacaaccggccctcagggatcccagaccgattctctggctccacctcaggaagcacagcttccttgaccatcactgcgactcaggcggacgatgaggctgactatttctgtagttcccgggacggcagtggtaatttcctcttcggcggagggaccaaactgaccgtcctt

SEQ ID NO: 626 - protein, 118 aa, ARTIFICIAL SEQUENCE
  Antibody
EVQLLESGGGLVQPGGSLRLSCAASGFTFSIYPMHWVRQAPGKGLEWVSSIYPSGGITRYADSVKGRFTISRDNSKNTLYLQMNSLRAEDTALYYCARQRGSGWHDSWGQGTLVTVSS

SEQ ID NO: 627 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctatttaccctatgcattgggttcgccaagctcctggtaaaggtttggagtgggtttcttctatctatccttctggtggcattactcgttatgctgactccgttaaaggtcgcttcactatctctagagacaactctaagaatactctctacttgcagatgaacagcttaagggctgaggacaccgccttgtattactgtgcgagacaacggggcagtggctggcatgactcctggggccagggaaccctggtcaccgtctcaagc

SEQ ID NO: 628 - protein, 108 aa, ARTIFICIAL SEQUENCE
  Antibody
QDIQMTQSPATLSLSPGERATLSCRASQSVSSYLAWYQQKPGQAPRLLIYDASNRATGIPARFSGSGSGTDFTLTISSLEPEDFAVYYCQQRSNWPVTFGQGTRLEIK

SEQ ID NO: 629 - DNA, 324 bp, ARTIFICIAL SEQUENCE
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccggtcaccttcggccaagggacacgactggagattaaa

SEQ ID NO: 630 - protein, 118 aa, ARTIFICIAL SEQUENCE
  Antibody
EVQLLESGGGLVQPGGSLRLSCAASGFTFSYYPMVWVRQAPGKGLEWVSVIVPSGGFTAYADSVKGRFTISRDNSKNTLYLQMNSLRAEDTAMYYCARKRPGNAFDIWGQGTMVTVSS

SEQ ID NO: 631 - DNA, 354 bp, ARTIFICIAL SEQUENCE
  Antibody
gaagttcaattgttagagtctggtggcggtcttgttcagcctggtggttctttacgtctttcttgcgctgcttccggattcactttctcttattaccctatggtttgggttcgccaagctcctggtaaaggtttggagtgggtttctgttatcgttccttctggtggctttactgcttatgctgactccgttaaaggtcgcttcactatctctagagacaactctaagaatactctctacttgcagatgaacagcttaagggctgaggacaccgccatgtattactgtgcgagaaagcgacctggaaatgcttttgatatctggggccaagggacaatggtcaccgtctcaagc

SEQ ID NO: 632 - protein, 107 aa, ARTIFICIAL SEQUENCE
  Antibody
QDIQMTQSPSFLSASVGDSVAITCRASQDISRFLAWYQQRPGKAPKLLIFSASTLQSGVPSRFSGSGSGTEFTLTINALQPEDFATYYCQQLSRYSTFGQGTKLEIK

SEQ ID NO: 633 - DNA, 321 bp, ARTIFICIAL SEQUENCE
  Antibody
caagacatccagatgacccagtctccatccttcctgtctgcatctgtaggagacagtgtcgccatcacttgccgggccagtcaggacattagtcgttttttagcctggtatcagcaaagaccagggaaagcccctaaactcctgattttttctgcttccactttacaaagtggggtcccatccaggttcagcggcagtggatctgggacagaatttactctcacaatcaacgccctgcagcctgaagattttgcaacttattactgtcaacaacttagtcgttattcgacgttcggccaaggcaccaaactggaaatcaaa

SEQ ID NO: 634 - protein, 117 aa, ARTIFICIAL SEQUENCE
  Antibody
EVQLLESGGGLVQPGGSLRLSCAASGFTFSYYKMWWVRQAPGKGLEWVSSISPGGWTHYADSVKGRFTISRDNSKNTLYLQMNSLRAEDTAVYYCARGPVSSGGDYWGQGTLVTVSS

SEQ ID NO: 635 - DNA, 351 bp, ARTIFICIAL SEQUENCE
  Antibody
gaagttcaattgttagagtctggtggcggtcttgttcagcctggtggttctttacgtctttcttgcgctgcttccggattcactttctcttattacaagatgtggtgggttcgccaagctcctggtaaaggtttggagtgggtttcttctatctctcctggtggctggactcattatgctgactccgttaaaggtcgcttcactatctctagagacaactctaagaatactctctacttgcagatgaacagcttaagggctgaggacacggccgtgtattactgtgctagaggccctgtcagtagtggtggggactactggggccagggaaccctggtcaccgtctcaagc

SEQ ID NO: 636 - protein, 109 aa, ARTIFICIAL SEQUENCE
  Antibody
QDIQMTQSPATLSLSPGERATLSCRASQSVSSYLAWYQQKPGQAPRLLIYDASNRATGIPARFSGSGSGTDFTLTISSLEPEDFAVYYCQQRSNWPPLTFGGGTKVEIK

SEQ ID NO: 637 - DNA, 327 bp, ARTIFICIAL SEQUENCE
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgctcactttcggcggagggaccaaggtggagatcaaa

SEQ ID NO: 638 - protein, 119 aa, ARTIFICIAL SEQUENCE
  Antibody
EVQLLESGGGLVQPGGSLRLSCAASGFTFSQYVMMWVRQAPGKGLEWVSSIYPSGGQTYYADSVKGRFTISRDNSKNTLYLQMNSLRAEDTAVYYCAKIAGGAYHLDYWGQGTLVTVSS

SEQ ID NO: 639 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctcagtacgttatgatgtgggttcgccaagctcctggtaaaggtttggagtgggtttcttctatctatccttctggtggccagacttattatgctgactccgttaaaggtcgcttcactatctctagagacaactctaagaatactctctacttgcagatgaacagcttaagggctgaggacacggccgtgtattactgtgcgaaaattgcagggggagcctaccaccttgattactggggccagggaaccctggtcaccgtctcaagc

SEQ ID NO: 640 - protein, 110 aa, ARTIFICIAL SEQUENCE
  Antibody
QYELTQPASVSGSPGQSITISCTGTSSDVGGYNYVSWYQQHPGKAPKLTIFDVTKRPSGVSDRFSGSKSDNTASLTISGLQAEDEADYYCGSYTSSGSRVFGTGTKVTVL

SEQ ID NO: 641 - DNA, 330 bp, ARTIFICIAL SEQUENCE
  Antibody
cagtacgaattgactcagcctgcctccgtgtctgggtctcctggacagtcgatcaccatctcctgcactggaaccagcagtgacgttggtggttataactatgtctcctggtaccaacaacacccaggcaaagcccccaaactcacgatttttgatgtcactaaacggccctcaggggtttctgatcgcttctctggctccaagtctgacaatacggcctccctgaccatctctgggctccaggctgaagacgaagctgattattactgcggctcatatacaagcagcggctctcgggtcttcggaactgggaccaaggtcaccgtcctc

SEQ ID NO: 642 - protein, 117 aa, ARTIFICIAL SEQUENCE
  Antibody
EVQLLESGGGLVQPGGSLRLSCAASGFTFSRYVMGWVRQAPGKGLEWVSRIYPSGGFTYYADSVKGRFTISRDNSKNTLYLQMNSLRAEDTAVYYCTRIREGYFDYWGQGTLVTVSS

SEQ ID NO: 643 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctcgttacgttatgggttgggttcgccaagctcctggtaaaggtttggagtgggtttctcgtatctatccttctggtggctttacttattatgctgactccgttaaaggtcgcttcactatctctagagacaactctaagaatactctctacttgcagatgaacagcttaagggctgaggacacggccgtgtattactgtacgaggataagggaagggtactttgactactggggccagggaaccctggtcaccgtctcaagc

SEQ ID NO: 644 - protein, 109 aa, ARTIFICIAL SEQUENCE
  Antibody
QDIQMTQSPSSLSASVGDRVAITCRASQSIDTYLNWYQQKPGKAPKLLIYAASKLEDGVPSRFSGSGTGTDFTLTIRSLQPEDFASYFCQQSYSSPGITFGPGTKVEIK

SEQ ID NO: 645 - DNA, 327 bp, ARTIFICIAL SEQUENCE
  Antibody
caagacatccagatgacccagtctccatcctccctgtctgcatctgtgggagacagagtcgccatcacttgccgcgcaagtcagagcatcgacacctatttaaattggtatcagcagaaaccagggaaagcccctaaactcctgatctatgctgcatccaagttggaagacggggtcccatcaagattcagtggcagtggaactgggacagatttcactctcaccatcagaagtctgcaacctgaagattttgcaagttatttctgtcaacagagctactctagtccagggatcactttcggccctgggaccaaggtggagatcaaa

SEQ ID NO: 646 - protein, 125 aa, ARTIFICIAL SEQUENCE
  Antibody
EVQLLESGGGLVQPGGSLRLSCAASGFTFSHYVMTWVRQAPGKGLEWVSSIYPSGGFTAYADSVTGRFTISRDNSKNTLYLQMNSLRAEDTAMYYCAKSTYYYEGSGYYRAFDIWGQGTMVTVSS

SEQ ID NO: 647 - DNA, 375 bp, ARTIFICIAL SEQUENCE
  Antibody
gaagttcaattgttagagtctggtggcggtcttgttcagcctggtggttctttacgtctttcttgcgctgcttccggattcactttctctcattacgttatgacttgggttcgccaagctcctggtaaaggtttggagtgggtttcttctatctatccttctggtggctttactgcttatgctgactccgttacaggtcgcttcactatctctagagacaactctaagaatactctctacttgcagatgaacagcttaagggctgaggacaccgccatgtattactgtgcgaaatcgacttattactatgagggtagtggttattaccgcgcttttgatatctggggccaagggacaatggtcaccgtctcaagc

SEQ ID NO: 648 - protein, 109 aa, ARTIFICIAL SEQUENCE
  Antibody
QDIQMTQSPATLSLSPGERATLSCRASQSVSSSYLAWYQQKPGQAPRLLIYGASNRATGIPARFSGSGSGTDFTLTISGLEPEDFVVYYCQKYGSSSLTFGGGTKVEIK

SEQ ID NO: 649 - DNA, 327 bp, ARTIFICIAL SEQUENCE
  Antibody
caagacatccagatgacccagtctccagccaccctgtctctatctccaggggaaagagccaccctctcctgcagggccagtcagagtgttagcagcagctacttagcctggtaccagcagaaacctggccaggctcccaggctcctcatctatggtgcatccaacagggccactggcatcccagccaggttcagtggcagtgggtctgggacagacttcactctcaccatcagtggcctggagcctgaagattttgtagtgtattactgtcagaagtatggtagttcatcgctcactttcggcggagggaccaaggtggagatcaaa

SEQ ID NO: 650 - protein, 119 aa, ARTIFICIAL SEQUENCE
  Antibody
EVQLLESGGGLVQPGGSLRLSCAASGFTFSQYKMWWVRQAPGKGLEWVSVIYPSGGVTYYADSVKGRFTISRDNSKNTLYLQMNSLRAEDTAVYYCAISYSPVGAFDIWGQGTMVTVSS

SEQ ID NO: 651 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctcagtacaagatgtggtgggttcgccaagctcctggtaaaggtttggagtgggtttctgttatctatccttctggtggcgttacttattatgctgactccgttaaaggtcgcttcactatctctagagacaactctaagaatactctctacttgcagatgaacagcttaagggctgaggacacggccgtgtattactgtgcgatctcgtatagtcccgtgggggcttttgatatctggggccaagggacaatggtcaccgtctcaagc

SEQ ID NO: 652 - protein, 110 aa, ARTIFICIAL SEQUENCE
  Antibody
QSALTQPPSVSGSPGQSVTISCTGTSSDVGSYNRVSWYRQPPGTAPKVIIYDINNRPSGVPDRFSGSRSGDTAYLTISGLQVEDEADYYCSSFTSSSTYIFGTGTKVTVL

SEQ ID NO: 653 - DNA, 330 bp, ARTIFICIAL SEQUENCE
  Antibody
cagagcgctttgactcagcctccctccgtgtccgggtctcctggacagtcagtcaccatttcctgcactggaaccagcagtgacgttggtagttataaccgtgtctcctggtaccggcagcccccaggcacagcccccaaagtcatcatttatgacatcaataatcggccctcaggtgtccctgatcgcttctctgggtccaggtctggcgacacggcctacctgaccatctctgggctccaggtggaggacgaggctgattattactgtagctcatttacaagcagcagcacctatatcttcggaactgggaccaaggtcaccgtcctg

SEQ ID NO: 654 - protein, 118 aa, ARTIFICIAL SEQUENCE
  Antibody
EVQLLESGGGLVQPGGSLRLSCAASGFTFSVYKMYWVRQAPGKGLEWVSVIYPSGGYTDYADSVKGRFTISRDNSKNTLYLQMNSLRAEDTAVYYCARQLPMSYFDYWGQGTLVTVSS

SEQ ID NO: 655 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctgtttacaagatgtattgggttcgccaagctcctggtaaaggtttggagtgggtttctgttatctatccttctggtggctatactgattatgctgactccgttaaaggtcgcttcactatctctagagacaactctaagaatactctctacttgcagatgaacagcttaagggctgaggacacggccgtgtattactgtgcgcggcagctgcccatgtcgtactttgactactggggccagggaaccctggtcaccgtctcaagc

SEQ ID NO: 656 - protein, 112 aa, ARTIFICIAL SEQUENCE
  Antibody
QDIQMTQSPLSLPVTPGEPASMSCRSSQSLLQSNGYNYLDWYLQKPGQSPQLLIYLGSNRASGVPDRFSGSGSGTDFTLKISRVEAEDVGVYYCMQALQTWTFGQGTKVEIK

SEQ ID NO: 657 - DNA, 336 bp, ARTIFICIAL SEQUENCE
  Antibody
caagacatccagatgacccagtctccactctccctgcccgtcacccctggagagccggcctccatgtcctgcaggtctagtcagagcctcctgcaaagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaacttggacgttcggccaagggaccaaggtggaaatcaaa

SEQ ID NO: 658 - protein, 117 aa, ARTIFICIAL SEQUENCE
  Antibody
EVQLLESGGGLVQPGGSLRLSCAASGFTFSRYVMVWVRQAPGKGLEWVSRIYPSGGFTNYADSVKGRFTISRDNSKNTLYLQMNSLRAEDTAVYYCARDKTAHMDVWGKGTTVTVSS

SEQ ID NO: 659 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctcgttacgttatggtttgggttcgccaagctcctggtaaaggtttggagtgggtttcgcgtatctatccttctggtggctttactaattatgctgactccgttaaaggtcgcttcactatctctagagacaactctaagaatactctctacttgcagatgaacagcttaagggctgaggacacggccgtgtattactgtgcgagagataagacagcccacatggacgtctggggcaaagggaccacggtcaccgtctcaagc

SEQ ID NO: 660 - protein, 109 aa, ARTIFICIAL SEQUENCE
  Antibody
QDIQMTQSPATLSLSPGERATLSCRASQSVSSYLAWYQQKPGQAPRLLIYDASNRATGIPARFSGSGSGTDFTLTISSLEPEDFAVYYCQQRSSWPPLTFGGGTKVEIK

SEQ ID NO: 661 - DNA, 327 bp, ARTIFICIAL SEQUENCE
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcagctggcctccgctcactttcggcggagggaccaaggtggagatcaag

SEQ ID NO: 662 - protein, 119 aa, ARTIFICIAL SEQUENCE
  Antibody
EVQLLESGGGLVQPGGSLRLSCAASGFTFSRYKMNWVRQAPGKGLEWVSSIYPSGGWTNYADSVKGRFTISRDNSKNTLYLQMNSLRAEDTAVYYCARGGRYGDYVRHWGQGTLVTVSS

SEQ ID NO: 663 - DNA, 357 bp, ARTIFICIAL SEQUENCE
  Antibody
gaagttcaattgttagagtctggtggcggtcttgttcagcctggtggttctttacgtctttcttgcgctgcttccggattcactttctctcgttacaagatgaattgggttcgccaagctcctggtaaaggtttggagtgggtttcttctatctatccttctggtggctggactaattatgctgactccgttaaaggtcgcttcactatctctagagacaactctaagaatactctctacttgcagatgaacagcttaagggctgaggacacggccgtgtattactgtgccagaggggggagatacggtgactacgtgcgtcactggggccagggaaccctggtcaccgtctcaagc

SEQ ID NO: 664 - protein, 108 aa, ARTIFICIAL SEQUENCE
  Antibody
QDIQMTQSPATLSVSPGERATLSCRASQSVSSNLAWYQHKPGQAPRLLIYGASIRATGIPARFSGSGSGTEFTLTISSLQSEDFGVYYCQQYKDWPRTFGQGTKVEIK

SEQ ID NO: 665 - DNA, 324 bp, ARTIFICIAL SEQUENCE
  Antibody
caagacatccagatgacccagtctccagccaccctgtctgtgtctccaggggaaagagccactctctcctgcagggccagtcagagtgttagcagcaacttagcctggtaccagcacaaacctggccaggctcccaggctcctcatctatggtgcatccatcagggccactggtatcccagccaggttcagtggcagtgggtctgggacagagttcactctcaccatcagcagcctgcagtctgaagattttggagtttattattgtcagcagtataaggactggcctcgaacgttcggccaagggaccaaggtggaaatcaaa

SEQ ID NO: 666 - protein, 120 aa, ARTIFICIAL SEQUENCE
  Antibody
EVQLLESGGGLVQPGGSLRLSCAASGFTFSRYRMAWVRQAPGKGLEWVSSIYPSGGVTYYADSVKGRFTISRDNSKNTLYLQMNSLRAEDTAVYYCARDLSIAAAGTAYWGQGTLVTVSS

SEQ ID NO: 667 - DNA, 360 bp, ARTIFICIAL SEQUENCE
  Antibody
gaagttcaattgttagagtctggtggcggtcttgttcagcctggtggttctttacgtctttcttgcgctgcttccggattcactttctctcgttaccgtatggcttgggttcgccaagctcctggtaaaggtttggagtgggtttcttctatctatccttctggtggcgttacttattatgctgactccgttaaaggtcgcttcactatctctagagacaactctaagaatactctctacttgcagatgaacagcttaagggctgaggacacggccgtgtattactgtgcaagagatcttagtatagcagcagctggtactgcctactggggccagggaaccctggtcaccgtctcaagc

SEQ ID NO: 668 - protein, 110 aa, ARTIFICIAL SEQUENCE
  Antibody
QDIQMTQSPGTLSLSPGERATLSCRASQSFVGSRNLAWYQQKPGQPPRLLIYGAFNRATGIPGRFSGSGSGTDFTLTISRLEPEDFAVYYCQQYGTSPRTFGGGTKVEIK

SEQ ID NO: 669 - DNA, 330 bp, ARTIFICIAL SEQUENCE
  Antibody
caagacatccagatgacccagtctccaggcacgctgtctttgtctccaggggaaagagccaccctctcctgcagggccagtcagagttttgtcggcagcagaaacttagcctggtaccagcaaaaacctggccagcctcccaggctcctcatctatggtgcattcaacagggccactggcatcccaggcaggtttagtggcagtggctctgggacagacttcactctcaccatcagcagactggagcctgaagattttgcagtgtattactgtcagcagtatggtacgtcacctcggactttcggcggagggaccaaagtggagatcaaa

SEQ ID NO: 670 - protein, 118 aa, ARTIFICIAL SEQUENCE
  Antibody
EVQLLESGGGLVQPGGSLRLSCAASGFTFSRYVMQWVRQAPGKGLEWFSSIYPSGGATIYADSVKGRFTISRDNSKNTLYLQMNSLRAEDTAVYYCARRGIPGYFDSWGQGTLVTVSS

SEQ ID NO: 671 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctcgttacgttatgcagtgggttcgccaagctcctggtaaaggtttggagtggttttcttctatctatccttctggtggcgctactatttatgctgactccgttaaaggtcgcttcactatctctagagacaactctaagaatactctctacttgcagatgaacagcttaagggctgaggacacggccgtgtattactgtgcgagaaggggaattccgggctactttgactcctggggccagggaaccctggtcaccgtctcaagc

SEQ ID NO: 672 - protein, 110 aa, ARTIFICIAL SEQUENCE
  Antibody
QDIQMTQSPLSLSASIGDRVTITCRASQSISTYLNWYQQKPGKAPKLLIYATSTLQSGVPSRFSGSGSGTEFILTISGLQPEDFATYYCQQFNFYPLTLGGGTRVEIKRT

SEQ ID NO: 673 - DNA, 330 bp, ARTIFICIAL SEQUENCE
  Antibody
caagacatccagatgacccagtctccactctccctgtctgcatctataggagacagagtcaccatcacttgccgggcaagtcagagcattagcacctatttaaattggtatcagcagaagccagggaaagcccctaaactcctgatctatgcaacttccactttacagagtggggtcccatcaaggttcagcggcagtggatctgggacagaattcattctcacaatcagcggcctgcagcctgaagattttgcaacttattactgtcaacagtttaatttttatcctctcactctcggcggagggaccagggtggagatcaaacgaact

SEQ ID NO: 674 - protein, 116 aa, ARTIFICIAL SEQUENCE
  Antibody
EVQLLESGGGLVQPGGSLRLSCAASGFTFSSYGMVWVRQAPGKGLEWVSSISPSGGNTGYADSVKGRFTISRDNSKNTLYLQMNSLRAEDTAVYYCARGNGGFDSWGQGTLVTVSS

SEQ ID NO: 675 - DNA, 348 bp, ARTIFICIAL SEQUENCE
  Antibody
gaagttcaattgttagagtctggtggcggtcttgttcagcctggtggttctttacgtctttcttgcgctgcttccggattcactttctcttcttacggtatggtttgggttcgccaagctcctggtaaaggtttggagtgggtttcttctatctctccttctggtggcaatactggttatgctgactccgttaaaggtcgcttcactatctctagagacaactctaagaatactctctacttgcagatgaacagcttaagggctgaggacacggccgtgtattactgtgcaagaggaaatggtggctttgactcctggggccagggaaccctggtcaccgtctcaagc

SEQ ID NO: 676 - protein, 110 aa, ARTIFICIAL SEQUENCE
  Antibody
QSVLTQPASVSGSPGQSITISCTGTSSDVGSYNLVSWYQQHPGKAPKLMIYEGSKRPSGVSNRFSGSKSGNTASLTISGLQAEDEADYYCCSYAGSSTYVFGTGTKVTVL

SEQ ID NO: 677 - DNA, 330 bp, ARTIFICIAL SEQUENCE
  Antibody
cagagcgtcttgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcacttatgtcttcggaactgggaccaaggtcaccgtccta

SEQ ID NO: 678 - protein, 118 aa, ARTIFICIAL SEQUENCE
  Antibody
EVQLLESGGGLVQPGGSLRLSCAASGFTFSHYVMSWVRQAPGKGLEWVSVIYPSGGWTGYADSVKGRFTISRDNSKNTLYLQMNSLRAEDTAVYYCARGVATTSFDYWGQGTLVTVSS

SEQ ID NO: 679 - DNA, 354 bp, ARTIFICIAL SEQUENCE
  Antibody
gaagttcaattgttagagtctggtggcggtcttgttcagcctggtggttctttacgtctttcttgcgctgcttccggattcactttctctcattacgttatgtcttgggttcgccaagctcctggtaaaggtttggagtgggtttctgttatctatccttctggtggctggactggttatgctgactccgttaaaggtcgcttcactatctctagagacaactctaagaatactctctacttgcagatgaacagcttaagggctgaggacacggccgtgtattactgtgcgagaggggtggcaactactagttttgactactggggccagggaaccctggtcaccgtctcaagc

SEQ ID NO: 680 - protein, 110 aa, ARTIFICIAL SEQUENCE
  Antibody
QDIQMTQSPATLSLSPGERATLSCRASQSVSSYLAWYQQKPGQAPRLLIYDASNRATGIPARFSGSGSGTDFTLTISSLEPEDFAVYYCQQRSNWPRSITFGQGTRLEIK

SEQ ID NO: 681 - DNA, 330 bp, ARTIFICIAL SEQUENCE
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcgatcgatcaccttcggccaagggacacgactggagattaaa

SEQ ID NO: 682 - protein, 121 aa, ARTIFICIAL SEQUENCE
  Antibody
EVQLLESGGGLVQPGGSLRLSCAASGFTFSRYLMRWVRQAPGKGLEWVSGIYPSGGITAYADSVKGRFTISRDNSKNTLYLQMNSLRAEDTAVYYCARASGSYYNYYFDYWGQGTLVTVSS

SEQ ID NO: 683 - DNA, 363 bp, ARTIFICIAL SEQUENCE
  Antibody
gaagttcaattgttagagtctggtggcggtcttgttcagcctggtggttctttacgtctttcttgcgctgcttccggattcactttctctcgttaccttatgcgttgggttcgccaagctcctggtaaaggtttggagtgggtttctggtatctatccttctggtggcattactgcttatgctgactccgttaaaggtcgcttcactatctctagagacaactctaagaatactctctacttgcagatgaacagcttaagggctgaggacacggccgtgtattactgtgcgagagcttcggggagttattataattactactttgactactggggccagggcaccctggtcaccgtctcaagc

SEQ ID NO: 684 - protein, 109 aa, ARTIFICIAL SEQUENCE; identical to SEQ ID NO: 588
  Antibody

SEQ ID NO: 685 - DNA, 327 bp, ARTIFICIAL SEQUENCE; identical to SEQ ID NO: 589
  Antibody

SEQ ID NO: 686 - protein, 117 aa, ARTIFICIAL SEQUENCE
  Antibody
EVQLLESGGGLVQPGGSLRLSCAASGFTFSAYVMHWVRQAPGKGLEWVSRIYPSGGITYYADSVKGRFTISRDNSKNTLYLQMNSLRAEDTAVYYCARGILTGPNYWGQGTLVTVSS

SEQ ID NO: 687 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctgcttacgttatgcattgggttcgccaagctcctggtaaaggtttggagtgggtttctcgtatctatccttctggtggcattacttattatgctgactccgttaaaggtcgcttcactatctctagagacaactctaagaatactctctacttgcagatgaacagcttaagggctgaggacacggccgtgtattactgtgcgagagggattttgactggcccaaactactggggccagggaaccctggtcaccgtctcaagc

SEQ ID NO: 688 - protein, 111 aa, ARTIFICIAL SEQUENCE
  Antibody
QSALTQSPSASASLGASVKLTCSLSSGHSSYAIAWHQQQPEKGPQYLMKVNSDGSHTKGDGIPDRFSGSSSGAERYLTISSLQSEDEADYYCQTWGTGSWVFGGGTKLTVL

SEQ ID NO: 689 - DNA, 333 bp, ARTIFICIAL SEQUENCE
  Antibody
cagagcgctttgactcaatcgccctctgcctctgcctccctgggagcctcggtcaagctcacctgcagtctgagcagtgggcacagcagctacgccatcgcatggcatcagcagcagccagagaagggcccccagtacttaatgaaggttaacagtgatggcagccacaccaagggggacgggatccctgatcgcttctcaggctccagctctggggctgagcgctacctcaccatctccagcctccagtctgaggatgaggctgactattactgtcagacctggggcactggctcttgggtgttcggcggagggaccaagctgaccgtccta

SEQ ID NO: 690 - protein, 117 aa, ARTIFICIAL SEQUENCE
  Antibody
EVQLLESGGGLVQPGGSLRLSCAASGFTFSRYKMSWVRQAPGKGLEWVSYIYPSGGHTEYADSVKGRFTISRDNSKNTLYLQMNSLRAEDTAVYYCAREREGTPDYWGQGTLVTVSS

SEQ ID NO: 691 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctcgttacaagatgtcttgggttcgccaagctcctggtaaaggtttggagtgggtttcttatatctatccttctggtggccatactgagtatgctgactccgttaaaggtcgcttcactatctctagagacaactctaagaatactctctacttgcagatgaacagcttaagggctgaggacacggccgtgtattactgtgcgagagaaagggaagggacccctgactactggggccagggaaccctggtcaccgtctcaagc

SEQ ID NO: 692 - protein, 111 aa, ARTIFICIAL SEQUENCE
  Antibody
QSVLTQPASVSGSPGQSITISCTGTSSDDVGGYNYVSWYQQHPGKAPKLLIYDVINRPSGVSNRFSGSKSGNTASLTISGLQAEDEADYYCSSYASSGARVFGTGTKVTVL

SEQ ID NO: 693 - DNA, 333 bp, ARTIFICIAL SEQUENCE
  Antibody
cagagcgtcttgactcagcctgcctccgtgtctgggtctcctggacagtcgatcaccatctcctgcactggaaccagcagtgacgacgttggtggttataactatgtctcctggtaccaacaacacccaggcaaagcccccaaactcctgatttatgatgtcattaatcggccctcaggagtttctaatcgcttctctgggtccaagtctggcaacacggcctccctgaccatctctgggctccaggctgaggacgaggctgattattactgcagctcatatgcaagcagcggcgctcgagtcttcggaactgggaccaaggtcaccgtccta

SEQ ID NO: 694 - protein, 121 aa, ARTIFICIAL SEQUENCE
  Antibody
EVQLLESGGGLVQPGGSLRLSCAASGFTFSIYPMIWVRQAPGKGLEWVSVIYPSGGHTRYADSVKGRFTISRDNSKNTLYLQMNSLRAEDTAVYYCTRRVYSSGSAYFDLWGRGTLVTVSS

SEQ ID NO: 695 - DNA, 363 bp, ARTIFICIAL SEQUENCE
  Antibody
gaagttcaattgttagagtctggtggcggtcttgttcagcctggtggttctttacgtctttcttgcgctgcttccggattcactttctctatttaccctatgatttgggttcgccaagctcctggtaaaggtttggagtgggtttctgttatctatccttctggtggccatactcgttatgctgactccgttaaaggtcgcttcactatctctagagacaactctaagaatactctctacttgcagatgaacagcttaagggctgaggacacagccgtgtattactgtacgagacgggtatatagtagtggttctgcgtacttcgatctctggggccgtggcaccctggtcaccgtctcaagc

SEQ ID NO: 696 - protein, 108 aa, ARTIFICIAL SEQUENCE
  Antibody
QDIQMTQSPSTLSASVGDRVTITCRASQSVAGLLAWFQQKPGKAPKLLISKASILETGVPSRFSGSGSGTEFTLTITSLQPDDFATYYCQQYSFNSGTFGQGTRVEMK

SEQ ID NO: 697 - DNA, 324 bp, ARTIFICIAL SEQUENCE
  Antibody
caagacatccagatgacccagtctccttccaccctgtctgcatctgtgggagacagagtcaccatcacctgccgggccagccagagtgttgctggcttgttggcctggtttcagcagaaaccgggcaaagcccctaaactcctcatctctaaggcgtctattttagagactggggtcccatcaaggttcagcggcagtggatctgggacagaattcactctcaccatcaccagcctgcagcctgatgatttcgcaacttattactgccaacaatatagtttcaattctgggacattcggccaagggaccagggtggaaatgaaa

SEQ ID NO: 698 - protein, 117 aa, ARTIFICIAL SEQUENCE
  Antibody
EVQLLESGGGLVQPGGSLRLSCAASGFTFSMYKMAWVRQAPGKGLEWVSYIYPSGGYTYYADSVKGRFTISRDNSKNTLYLQMNSLRAEDTALYYCARVRDSAFDIWGQGTMVTVSS

SEQ ID NO: 699 - DNA, 351 bp, ARTIFICIAL SEQUENCE
  Antibody
gaagttcaattgttagagtctggtggcggtcttgttcagcctggtggttctttacgtctttcttgcgctgcttccggattcactttctctatgtacaagatggcttgggttcgccaagctcctggtaaaggtttggagtgggtttcttatatctatccttctggtggctatacttattatgctgactccgttaaaggtcgcttcactatctctagagacaactctaagaatactctctacttgcagatgaacagcttaagggctgaggacaccgccttgtattactgtgcgagagtaagggattccgcttttgatatctggggccaagggacaatggtcaccgtctcaagc

SEQ ID NO: 700 - protein, 214 aa, Artificial Sequence
  Antibody
DIQMTQSPSSLSASVGDRVTITCRASQGIGHYLAWYQQKPGKVPKLLIYTASTLQSGVPSRFSGSGSGTDFTLTISSLQPEDVATYYCQQFNSYPHTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 701 - protein, 450 aa, Artificial Sequence
  Antibody
EVQLLESGGGLVQPGGSLRLSCAASGFTFSMYGMVWVRQAPGKGLEWVSVISPSGGNTGYADSVKGRFTISRDNSKNTLYLQMNSLRAEDTAVYYCARAPRGYSYGYYYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 702 - DNA, 660 bp, Artificial Sequence
  Antibody
ggcgtgcactctgacatccagatgacccagtctccatcctccctgtctgcatctgtaggagacagagtcaccatcacttgccgggcgagtcagggcattggccattatttagcctggtatcagcagaaaccagggaaagttcctaagctcctgatctatactgcatccactttgcaatcaggggtcccatctcggttcagtggcagtggatctgggacagatttcactctcaccatcagcagcctgcagcctgaagatgttgcaacttattactgtcaacagtttaatagttaccctcacaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaataa

SEQ ID NO: 703 - DNA, 1353 bp, Artificial Sequence
  Antibody
gaagttcaattgttagagtctggtggcggtcttgttcagcctggtggttctttacgtctttcttgcgctgcttccggattcactttctctatgtacggtatggtttgggttcgccaagctcctggtaaaggtttggagtgggtttctgttatctctccttctggtggcaatactggttatgctgactccgttaaaggtcgcttcactatctctagagacaactctaagaatactctctacttgcagatgaacagcttaagggctgaggacactgcagtctactattgtgcgagagccccacgtggatacagctatggttactactactggggccagggaaccctggtcaccgtctcaagcgcctccaccaagggcccatcggtcttcccgctagcaccctcctccaagagcacctctgggggcacagcggccctgggctgcctggtcaaggactacttccccgaaccggtgacggtgtcgtggaactcaggcgccctgaccagcggcgtccacaccttcccggctgtcctacagtcctccggactctactccctcagcagcgtagtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 704 - protein, 13 aa, Artificial Sequence
  Synthetically generated peptide
  VARIANT 1: Xaa = any amino acid
  VARIANT 8: Xaa = Trp, Pro or Ser
  VARIANT 10: Xaa = Tyr, Val or His
XIYPSGGXTXYAD

SEQ ID NO: 705 - protein, 8 aa, Artificial Sequence
  Synthetically generated peptide
  VARIANT 2, 3: Xaa = any amino acid
  VARIANT 5: Xaa = Ala, Tyr
  VARIANT 8: Xaa = Tyr, Ile
GXXGXFDX

SEQ ID NO: 706 - protein, 11 aa, Artificial Sequence
  Synthetically generated peptide
  VARIANT 6: Xaa = Ile, Val
  VARIANT 9: Xaa = Tyr, Ser
  VARIANT 11: Xaa = Ala, Leu, Asn
RASQSXSSXLX

SEQ ID NO: 707 - protein, 10 aa, Artificial Sequence
  Synthetically generated peptide
  VARIANT 4: Xaa = Ser, Asn
  VARIANT 9: Xaa = Gly, Ser
TGTXSDVGXY

SEQ ID NO: 708 - protein, 10 aa, Artificial Sequence
  Synthetically generated peptide
  VARIANT 1: Xaa = Ser, Gly, Gln
  VARIANT 2: Xaa = Gly, Ser
  VARIANT 3: Xaa = Asp, Ser
  VARIANT 4: Xaa = Asn, Ser
  VARIANT 5: Xaa = Ile, Leu
  VARIANT 6: Xaa = Gly, Arg
  VARIANT 8: Xaa = Tyr, Lys, Asn
  VARIANT 9: Xaa =  Tyr, Ser
  VARIANT 10: Xaa = Val, Ala
XXXXXXSXXX

SEQ ID NO: 709 - protein, 7 aa, Artificial Sequence
  Synthetically generated peptide
  VARIANT 1: Xaa = Asp, Gly
  VARIANT 2: Xaa = Ala, Val
  VARIANT 5: Xaa = Arg, Leu
  VARIANT 6: Xaa = Ala, Pro
  VARIANT 7: Xaa = Ser, Thr
XXSNXXX

SEQ ID NO: 710 - protein, 10 aa, Artificial Sequence
  Synthetically generated peptide
  VARIANT 3, 8: Xaa = any amino acid
  VARIANT 5: Xaa = Ser, Asn
  VARIANT 6: Xaa = Trp, Ser
QQXSXXPXTF

SEQ ID NO: 711 - protein, 8 aa, Artificial Sequence
  Synthetically generated peptide
  VARIANT 2: Xaa = Thr, Gly
  VARIANT 3: Xaa = Ser, Gly
  VARIANT 5: Xaa = Pro, Gly, Ser
  VARIANT 6: Xaa = Thr, Asn
  VARIANT 7: Xaa = any amino acid
  VARIANT 8: Xaa = Val, Thr
YXXSXXXX

SEQ ID NO: 712 - protein, 11 aa, Artificial Sequence
  Synthetically generated peptide
APRGYSYGYYY

SEQ ID NO: 713 - protein, 7 aa, Artificial Sequence
  Synthetically generated peptide
  VARIANT 1: Xaa = Thr, Ala, Gly, Asp
  VARIANT 4: Xaa = Ser, Thr, Asn
  VARIANT 5: Xaa = Leu, Arg
  VARIANT 6: Xaa = Ala, Glu, Gln
  VARIANT 7: Xaa = Ser, Thr
XASXXXX

SEQ ID NO: 714 - protein, 9 aa, Artificial Sequence
  Synthetically generated peptide
  VARIANT 3: Xaa =Ser, Tyr, Phe, Arg
  VARIANT 4: Xaa = Gly, Ser, Tyr, Asn
  VARIANT 6: Xaa = Ser, Thr, Tyr, Trp
  VARIANT 7: Xaa = Arg, Pro
  VARIANT 8: Xaa = Leu, His, Trp, Arg
  VARIANT 9: Xaa = Thr, Ile, Tyr
QQXXSXXXX

SEQ ID NO: 715 - protein, 9 aa, Artificial Sequence
  Synthetically generated peptide
  VARIANT 1: Xaa = Leu, Gln
  VARIANT 3: Xaa = Ser, Tyr, Phe, Arg
  VARIANT 4: Xaa = Gly, Ser, Tyr, Asn
  VARIANT 5: Xaa = Ser, Lys, Asn
  VARIANT 6: Xaa = Ser, Thr, Tyr, Trp
  VARIANT 7: Xaa = Arg, Pro
  VARIANT 8: Xaa = Leu, His, Trp, Arg
  VARIANT 9: Xaa = Thr, Ile, Tyr
XQXXXXXXX

SEQ ID NO: 716 - protein, 9 aa, Artificial Sequence
  Synthetically generated peptide
  VARIANT 1, 2: Xaa = Leu, Gln
  VARIANT 3: Xaa = Ser, Tyr, Phe, Arg, Asp
  VARIANT 4: Xaa = Gly, Ser, Tyr, Asn
  VARIANT 5: Xaa = Ser, Thr, Arg, Lys, Asn
  VARIANT 6: Xaa = Ser, Thr, tyr, Trp, Phe
  VARIANT 7: Xaa = Arg,  Pro
  VARIANT 8: Xaa = Ile, Leu, Met, Trp, Arg, His
  VARIANT 9: Xaa = Thr, Ile, Tyr
XXXXXXXXX

SEQ ID NO: 717 - DNA, 51 bp, Artificial Sequence
  Primer
ttcactatctctagagacaactctaagaatactctctacttgcagatgaac

SEQ ID NO: 718 - protein, 17 aa, Artificial Sequence
  Synthetically generated peptide
FTISRDNSKNTLYLQMN

SEQ ID NO: 719 - DNA, 23 bp, Artificial Sequence
  Primer
ggagggtgctagcgggaagaccg

SEQ ID NO: 720 - DNA, 296 bp, Artificial Sequence
  Synthetically generated oligonucleotide
  CDS (1)...(296)
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaga

SEQ ID NO: 721 - protein, 98 aa, Artificial Sequence
  Synthetically generated peptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAK

---

What is claimed:

1. An isolated protein comprising a heavy chain (HC) immunoglobulin variable domain sequence and a light chain (LC) immunoglobulin variable domain sequence, wherein the protein binds to Tie1 ectodomain and
    (A) the HC immunoglobulin variable domain sequence comprises:
        i) a HC CDR1 that comprises the amino acid sequence (AGSIMRH)-Y-(GVMK)-M-(GSVMFH) (SEQ ID NO:118);
        ii) a HC CDR2 that comprises the amino acid sequence (GSV)-I-(SY)-P-S-G-G-(WNQ)-T-(GY) (SEQ ID NO: 160);
        iii) a HC CDR3 that comprises the amino acid sequence A-P-R-G-Y-S-Y-G-Y-Y-Y (amino acids 99-109 of SEQ ID NO:114); and
    B) the LC immunoglobulin variable domain sequence comprises:
        i) a LC CDR1 that comprises the amino acid sequence R-A-S-(REQ)-(GSTRN)-(IV)-(GSTIRN)-(STIRH)-X1-(SYWNH)-(LV)-(ASN) (SEQ ID NO:132), wherein X1 is serine or absent;
        ii) a LC CDR2 that comprises the amino acid sequence (AGTKDEH)-A-S-(STN)-(LR)-(AVEQ)-(ST) (SEQ ID NO: 136); and
        iii) a LC CDR3 that comprises the amino acid sequence Q-Q-(SYFR)-(GSYN)-S-(STYW)-(RP)-(LWRH)-(TIY) (SEQ ID NO: 161).

2. The isolated protein of claim 1,
    wherein the HC immunoglobulin variable domain comprises a sequence that is at least 85% identical to the HC immunoglobulin variable domain of SEQ ID NO: 114 or
    wherein the HC immunoglobulin variable domain comprises residues 1-141 of SEQ ID NO:701.

3. The protein of claim 1 that inhibits tube formation by HUVEC cells in vitro.

4. The protein of claim 1, wherein the protein binds to a Tie1 ectodomain and competes with an antibody for binding to Tie1, wherein the antibody HC variable domain comprises SEQ ID NO:114 or residues 1-141 of SEQ ID NO:701, and the antibody LC variable domain comprises SEQ ID NO:116 or SEQ ID NO:159.

5. A pharmaceutical composition comprising a protein of claim 1 and a pharmaceutically acceptable carrier.

6. The isolated protein of claim 1,
    wherein the HC immunoglobulin variable domain comprises a sequence that is encoded by a nucleic acid that hybridizes with high stringency to a nucleic acid encoding the antibody HC immunoglobulin variable domain of SEQ ID NO:114 or
    wherein the HC immunoglobulin variable domain comprises residues 1-141 of SEQ ID NO:701.

7. The isolated protein of claim 1,
    wherein the LC immunoglobulin variable domain comprises a sequence that is at least 85% identical to the antibody LC immunoglobulin variable domain of SEQ ID NO:116 or wherein the LC immunoglobulin variable domain comprises SEQ ID NO:159.

8. The isolated protein of claim 1,
wherein the HC and LC immunoglobulin variable domain sequences are at least 85% identical to the antibody HC and LC immunoglobulin variable domains of SEQ ID NOS:114 and 116, respectively, or
wherein the HC and LC immunoglobulin variable domain sequences comprise residues 1-141 of SEQ ID NO:701 and SEQ ID NO:159, respectively.

9. The isolated protein of claim 1, wherein the protein comprises the HC immunoglobulin variable domain of SEQ ID NO:114.

10. The isolated protein of claim 1, wherein the protein comprises the LC immunoglobulin variable domain of SEQ ID NO:116.

11. The isolated protein of claim 1, wherein the protein comprises the HC and LC immunoglobulin variable domains of the antibody of SEQ ID NOS:114 and 116, respectively.

12. The isolated protein of claim 1, wherein the protein comprises the HC immunoglobulin variable domain of residues 1-141 of SEQ ID NO:701.

13. The isolated protein of claim 1, wherein the protein comprises the LC immunoglobulin variable domain of SEQ ID NO:159.

14. The isolated protein of claim 1, wherein the protein comprises the HC and LC immunoglobulin variable domains of the antibody of residues 1-141 of SEQ ID NO:701 and SEQ ID NO:159, respectively.

15. The isolated protein of claim 1, wherein the protein comprises the HC of SEQ ID NO:701.

16. The isolated protein of claim 1, wherein the protein comprises the LC of SEQ ID NO:700.

17. A method of decreasing angiogenesis in a subject, the method comprising administering to a subject an effective amount of the isolated protein of claim 1, wherein the subject has a disorder selected from the group consisting of a neoplastic disorder, a metastatic cancer and an angiogenesis-dependent cancer or tumor.

18. The method of claim 17, wherein the isolated protein is an antibody that binds to the extracellular domain of human Tie1.

19. The method of claim 17, wherein the isolated protein is administered for a time effective to decrease angiogenesis in the subject.

20. A method of treating an angiogenesis-related disorder in a subject by decreasing angiogenesis in the subject, the method comprising providing a first therapy that comprises administering to the subject the isolated protein of claim 1 in combination with a second therapy, wherein the angiogenesis-related disorder is a disorder selected from the group consisting of a neoplastic disorder, a metastatic cancer and an angiogenesis-dependent cancer or tumor.

21. The method of claim 20, wherein the second therapy is an anti-cancer therapy and the subject is diagnosed with cancer.

22. The method of claim 21, wherein the anti-cancer therapy comprises administration of an agent that antagonizes signaling through a VEGF pathway.

23. A method for detecting the presence of a Tie1 protein in a sample in vitro, the method comprising:
(i) contacting the sample with the isolated protein of claim 1 in vitro, under conditions that allow interaction of the isolated protein and the Tie1 protein to occur; and
(ii) detecting formation of a complex between the Tie-binding protein and the sample, thereby detecting the presence of a Tie1 protein in a sample in vitro.

24. A method for detecting and or/localizing a Tie1 protein in a subject in vivo, the method comprising:
(i) administering to a subject the isolated protein of claim 1, under conditions that allow interaction of the isolated protein and the Tie1 protein to occur; and
(ii) detecting formation of a complex between the isolated protein and the Tie1 protein or detecting distribution of the isolated protein in at least one location in the subject.

25. The method of claim 24, wherein the subject is a human.

26. The method of claim 17, wherein the angiogenesis-dependent cancer or tumor is a renal cancer.

27. The method of claim 17, wherein the angiogenesis-dependent cancer or tumor is a hepatic cancer or a hepatoma.

28. The method of claim 20, wherein the angiogenesis-dependent cancer or tumor is a renal cancer.

29. The method of claim 20, wherein the angiogenesis-dependent cancer or tumor is a hepatic cancer or a hepatoma.

* * * * *